United States Patent
Shattuck et al.

(10) Patent No.: US 7,314,713 B1
(45) Date of Patent: Jan. 1, 2008

(54) OBESITY GENE AND USE THEREOF

(75) Inventors: Donna M. Shattuck, Salt Lake City, UT (US); Steven Stone, Sandy, UT (US); Deanna L. Russell, Salt Lake City, UT (US); Victor Abkevich, Salt Lake City, UT (US); Steven Hunt, Salt Lake City, UT (US)

(73) Assignees: Myriad Genetics, Inc., Salt Lake City, UT (US); University of Utah, Salt Lake City, UT (US)

( * ) Notice: Subject to any disclaimer, the term of this patent is extended or adjusted under 35 U.S.C. 154(b) by 399 days.

(21) Appl. No.: 10/655,543

(22) Filed: Sep. 3, 2003

Related U.S. Application Data

(60) Provisional application No. 60/433,074, filed on Dec. 13, 2002, provisional application No. 60/407,817, filed on Sep. 3, 2002.

(51) Int. Cl.
  *C12Q 1/68* (2006.01)
  *C12P 19/34* (2006.01)
  *C07H 21/02* (2006.01)
  *C07H 21/04* (2006.01)
  *G01N 33/53* (2006.01)

(52) U.S. Cl. .................. 435/6; 435/91.1; 435/91.2; 536/24.3

(58) Field of Classification Search .................. None
  See application file for complete search history.

(56) References Cited

U.S. PATENT DOCUMENTS 5,700,927 A * 12/1997 Zon et al. .................. 536/23.5

6,825,004 B1 * 11/2004 Blumenfeld et al. ....... 435/69.1

OTHER PUBLICATIONS

Genbank Accession No. NM_015173; Sep. 2005.*
Genbank Accession No. NM_015173; Oct. 2002.*
Genbank Accession No. NP_055988; Sep. 2005.*
Genbank Accession No. NP_055988; Oct. 2002.*
Richardson et al., "Molecular cloning of a cDNA with a novel domain present in the *tre-2* oncogene and the yeast cell cycle regulators *BUB2* and *cdc16*", Oncogene, Sept. 1995, 11(6):1139-1148.
White et al., "The gene encoding TBC1D1 with homology to the tre-2/USP6 oncogene, BUB2, and cdc16 maps to mouse chromosome 5 and human chromosome 4", Cytogenetics and Cell Genetics, 2000, 89(3-4):272-275.

* cited by examiner

*Primary Examiner*—Jehanne Sitton
(74) *Attorney, Agent, or Firm*—Herbert L. Ley, III; Jay Z. Zhang; Myriad Genetics IP Dept.

(57) ABSTRACT

The present invention relates generally to the field of human genetics. Specifically, the present invention relates to methods and materials used to isolate and detect a human obesity and diabetes predisposing gene, specifically the TBC1D1 gene, some mutant alleles of which cause susceptibility to obesity and/or diabetes. More specifically, the invention relates to germline mutations in the TBC1D1 gene and their use in the diagnosis of predisposition to obesity and diabetes. Finally, the invention relates to the screening of the TBC1D1 gene for mutations/alterations, which are useful for diagnosing the predisposition to obesity.

7 Claims, 1 Drawing Sheet

OBESITY GENE AND USE THEREOF

CROSS REFERENCE TO OTHER U.S. APPLICATIONS

This application claims the benefit (under 35 U.S.C. § 119(e)) of U.S. Provisional Application Ser. No. 60/407,817 filed Sep. 3, 2002, and U.S. Provisional Application Ser. No. 60/433,074 filed Dec. 13, 2002, the contents of both of which are incorporated herein by reference in their entirety.

FIELD OF THE INVENTION

This invention relates generally to the field of human genetics, and particularly to an isolated human obesity predisposing gene and use thereof.

BACKGROUND OF THE INVENTION

Generally, obesity is defined as an excess of adipose tissue; and clinically, it is defined as that amount of adiposity that imparts a health risk. Even mild obesity, at 20% over desirable weight according to standard height-weight charts, may increase the risk for disease and premature death. While the etiology of obesity and diabetes is not entirely overlapping, it is now amply clear that both share appreciable biochemical and physiological components.

The incidence of the metabolic disorders of diabetes and obesity has reached epidemic levels. It has been estimated that over 120 million Americans are clinically over-weight and more than ten million Americans are diagnosed with diabetes every year. Moreover, obesity and diabetes can cause or contribute to the development of, or at least affect the treatment of, other diseases and disorders such as cardiovascular diseases, stroke, hypertension, and kidney failure. The combined economic burden of diabetes and obesity and the co-morbidities associated with these disorders is estimated to be over $100 billion a year. Obesity and diabetes have a major impact on human health and the various national healthcare systems all over the world.

Recently launched weight-loss drugs have failed or have demonstrated limited efficacy and undesirable side effects. Similarly, despite a tremendous medical need, the pharmaceutical industry has realized only limited success developing therapeutics to manage diabetes. The most common therapeutics (sulfonylureas) are not effective and the most promising new drugs (thiazolidinediones) have demonstrated rare but fatal side effects. Thus, there is an urgent need for a more comprehensive understanding of the molecular basis of obesity and diabetes, for diagnosis tests that allow early detection of predispositions to the disorders, and for more effective pharmaceuticals for preventing and treating the diseases without undesirable side effects.

SUMMARY OF THE INVENTION

This invention provides the first evidence implicating specific mutations in the TBC1D1 gene (also known as the cg79 gene) with susceptibility to obesity, thus associating the functions of the TBC1D1 gene product with increased adiposity and associated increased health risk.

In a first aspect of the invention, novel nucleotide sequences and amino acid sequences relating to the TBC1D1 gene and protein are provided. In particular, a nucleotide sequence encoding the wild-type full-length TBC1D1 protein has been discovered. In addition, mutations in the TBC1D1 nucleotide sequence associated with an elevated risk of obesity have also been discovered based on familial linkage analyses. Thus, mutant TBC1D1 nucleotide sequences including such mutations are disclosed, as are altered TBC1D1 amino acid sequences. Additionally, several heretofore unknown alternatively spliced forms of the TBC1D1 coding sequence (CDS), and corresponding mRNA/cDNA sequences, have been discovered, and the sequences of such alternative splice forms are disclosed.

In a second aspect of the invention, a method for detecting susceptibility in an individual to obesity and/or diabetes is provided. Thus, the present invention provides methods for determining whether a subject is at risk for developing obesity and/or diabetes due to a mutation in the TBC1D1 gene. This method relies on the fact that the inventors have correlated mutations in the TBC1D1 with the diseases. It will be understood by those of skill in the art, given the disclosure of the invention, that such mutations are associated with a susceptibility to obesity and/or diabetes, and that a variety of methods may be utilized to detect mutations in the TBC1D1 gene, including the mutations disclosed herein, which are associated with a susceptibility to obesity and/or diabetes.

The method can include detecting, in a tissue of the subject, the presence or absence of a polymorphism of the TBC1D1 gene or a TBC1D1 gene product. The detection of a polymorphism in the TBC1D1 gene may include ascertaining the existence of at least one of: a deletion of one or more nucleotides; an addition of one or more nucleotides; a substitution of one or more nucleotides; a gross chromosomal rearrangement; an alteration in the level of a messenger RNA transcript; the presence of a non-wild type splicing pattern of a messenger RNA transcript; a non-wild type level of TBC1D1 protein; and/or an aberrant level of TBC1D1 protein.

For example, detecting the polymorphism can include (i) providing a probe/primer comprised of an oligonucleotide that hybridizes to a sense or antisense sequence of the TBC1D1-encoding nucleic acid, or naturally occurring mutants thereof, or 5' or 3' flanking sequences naturally associated with the TBC1D1 gene; (ii) contacting the probe/primer to an appropriate nucleic acid containing sample; and (iii) detecting, by hybridization of the probe/primer to the nucleic acid, the presence or absence of the polymorphism; e.g. wherein detecting the polymorphism comprises utilizing the probe/primer to determine the nucleotide sequence of a TBC1D1 gene and, optionally, of the flanking nucleic acid sequences. For instance, the primer can be employed in a polymerase chain reaction (PCR), in a ligase chain reaction (LCR) or other amplification reactions known to a skilled artisan. In alternate embodiments, the level of a TBC1D1 protein is detected in an immunoassay using an antibody that is specifically immunoreactive with the TBC1D1 protein.

In a third aspect of the invention, compounds that are agonists or antagonists of a normal (functional) TBC1D1 bioactivity are provided, as are their use in preventing or treating obesity and/or diabetes. For example, to ameliorate disease symptoms involving insufficient expression of a TBC1D1 gene and/or inadequate amount of functional TBC1D1 bioactivity in a subject, a gene therapeutic (comprising a gene encoding a functional TBC1D1 protein) or a protein therapeutic (comprising a functional TBC1D1 protein or fragment thereof) can be administered to a subject. Alternatively, agonists or antagonists of TBC1D1 function (wild-type or mutant) or a TBC1D1 receptor or a receptor for fragments of TBC1D1 can be administered.

In a fourth aspect of the invention, compounds that are antagonists of a disease causing TBC1D1 bioactivity are provided; as are and their use in preventing or treating obesity. For example, to ameliorate disease symptoms involving expression of a mutant TBC1D1 gene or aberrant expression of a normal TBC1D1 gene in a subject, a therapeutically effective amount of a small interfering RNA (siRNA), antisense, ribozyme, or triple helix molecule, to reduce or prevent gene expression may be administered to the subject. Alternatively, to ameliorate disease symptoms involving the regulation via the TBC1D1 protein or TBC1D1 protein fragments of an upstream or downstream element in a TBC1D1-mediated biochemical pathway (e.g. signal transduction), a therapeutically effective amount of an agonist or antagonist compound (e.g. small molecule, peptide, peptidomimetic, protein or antibody), which can prevent normal binding of the wild type TBC1D1 protein, can induce a therapeutic effect.

In another aspect of the invention, assays, e.g., for screening test compounds to identify antagonists (e.g. inhibitors), or alternatively, agonists (e.g. potentiators), of an interaction between a TBC1D1 protein and, for example, a protein or nucleic acid that binds to the TBC1D1 protein, or fragments of TBC1D1, are provided. An exemplary method includes the steps of (i) combining a TBC1D1 polypeptide or bioactive fragments thereof, a TBC1D1 target molecule (such as a TBC1D1 ligand or nucleic acid), and a test compound, e.g., under conditions wherein, but for the test compound, the TBC1D1 protein and TBC1D1 target molecule are able to interact; and (ii) detecting the formation of a complex which includes the TBC1D1 protein and the target molecule either by directly quantitating the complex or by measuring inductive effects of the TBC1D1 protein, or fragments of the TBC1D1 protein. A statistically significant change, such as a decrease, in the interaction of the TBC1D1 protein and TBC1D1 target molecule in the presence of a test compound (relative to what is detected in the absence of the test compound) is indicative of a modulation (e.g., inhibition or potentiation of the interaction between the TBC1D1 protein, or fragments of the TBC1D1 protein, and the target molecule).

DETAILED DESCRIPTION OF THE INVENTION

The present invention is based in part on the discovery of polymorphisms in the TBC1D1 gene that are genetically linked to obesity. In addition, it has also been found that the TBC1D1 protein (TBC1D1) is involved in a diabetes pathway and may function in cellular glucose uptake. Based on these findings, the invention provides therapeutic methods, compositions and diagnostic assays for obesity and/or diabetes based on TBC1D1-encoding nucleic acids, and the TBC1D1 protein.

The inventors have discovered that a number of splice variants of TBC1D1 exist, each of which is encoded by a unique combination of exons that are spliced together to form the TBC1D1 coding sequence (CDS). The most common form of the TBC1D1 CDS is provided as SEQ ID NO:1. The corresponding amino acid sequence is set forth in SEQ ID NO:2. In addition, mutant cDNAs bearing germline mutations in their CDSs have also been isolated. The sequences of the CDSs of these mutant transcripts are shown in SEQ ID NOs:15, 17, 19 and 21, and the amino acid sequences encoded by the CDSs are shown in SEQ ID NOs:16, 18, 20 and 22, respectively. The mutation found in disequilibrium with obesity and provided in SEQ ID NO:15 is C373T, which corresponds to an amino acid variant R125W, provided in SEQ ID NO:16. The mutation found in disequilibrium with obesity and provided in SEQ ID NO:17 is T683G, which corresponds to an amino acid variant V228G, provided in SEQ ID NO:18. The mutation found in disequilibrium with obesity and provided in SEQ ID NO:19 is C1174G, which corresponds to an amino acid variant L392V, provided in SEQ ID NO:20. The mutations found in disequilibrium with obesity and provided in SEQ ID NO:21 are T683G and C1174G, which correspond to amino acid variants V228G and L392V, respectively, provided in SEQ ID NO:22.

Based on cDNA cloning and sequence analysis, a large number of exons of TBC1D1 have been found. These exons can be alternatively spliced to create several different splice variants, as described below. The nucleotide sequences of the individual exons encoding portions of all known forms of TBC1D1 are provided in SEQ ID NOs:33, 35, 37, 39, 41, 43, 45, 47, 49, 51, 53, 55, 57, 59, 61, 63, 65, 67, 69, 71, 73, 75, 77, 79, and 80. Exon 1 encodes a portion of the TBC1D1 transcript 5'-UTR, as well as the first 139 amino acid residues from the N-terminus of TBC1D1. The portion of the 5' UTR encoded by exon 1 corresponds to that found just upstream (5') of the translation initiation codon—a portion present in all known TBC1D1 transcripts.

Figure 1:
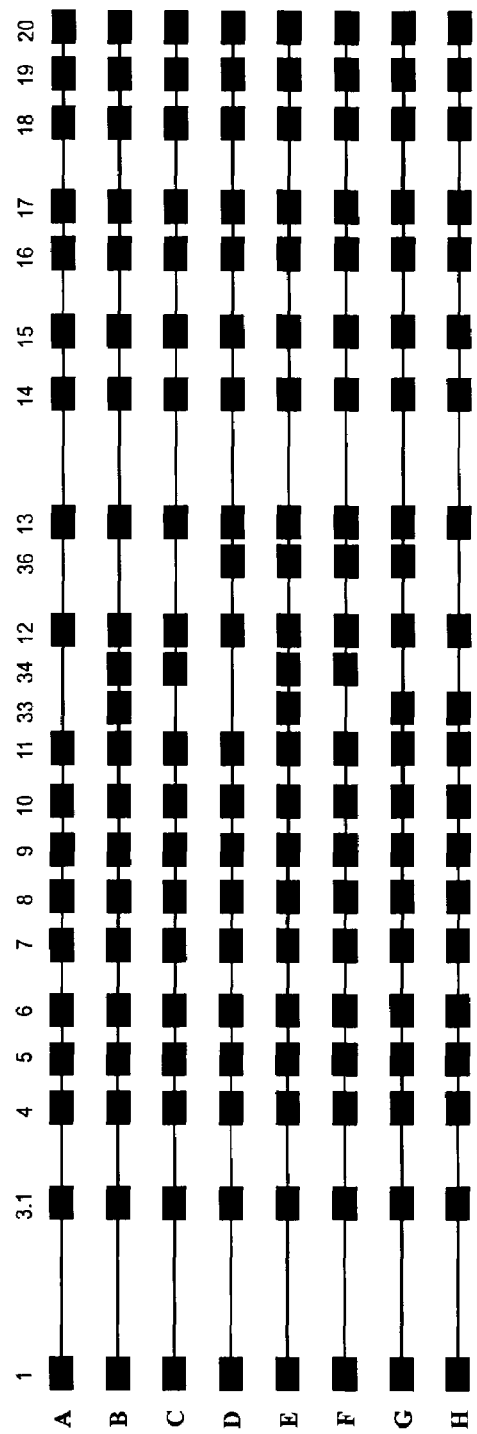
FIG. 1 is a schematic diagram showing the exon structures of various alternatively spliced forms of TBC1D1 coding sequence. The sequences of the exons identified by numbers in the FIGURE are provided in the sequence listing.
Figure 1:
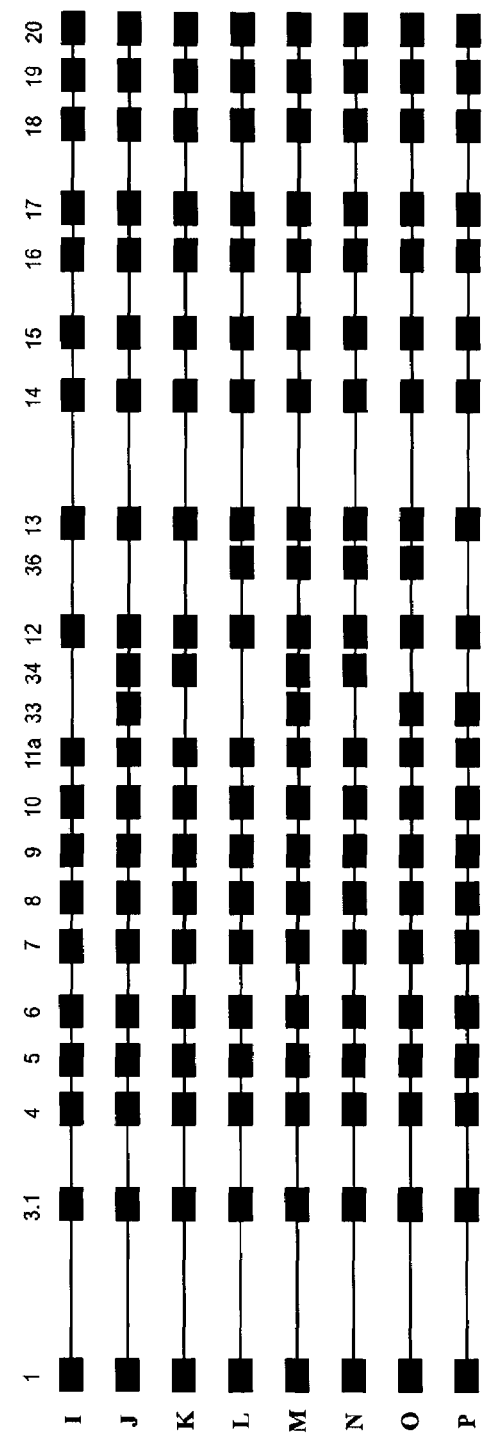

The structural arrangements of exons in the coding regions of various alternatively spliced TBC1D1 CDS variants are shown schematically in FIG. 1. Each of the structures depicted may be appended to either of the sequences encoded by exons 22 and 23, as described below, to create a cDNA with 5' and 3' UTRs. The nucleotide sequences corresponding to the CDSs of structural variants A-P, as illustrated in FIG. 1, are provided in SEQ ID NOs:1, 29, 31, 81, 83, 85, 87, 89, 91, 93, 95, 97, 99, 101, 103, and 105, respectively, and their encoded amino acid sequences are provided in SEQ ID NOs:2, 30, 32, 82, 84, 86, 88, 90, 92, 94, 96, 98, 100, 102, 104 and 106, respectively. TBC1D1 transcripts have been found to contain one of two alternative 5'-UTRs. The 5'-most regions of these alternative 5'-UTRs correspond to either of the sequences encoded by one of two nontranslated exons, designated exon 22 (SEQ ID NO:79) and exon 23 (SEQ ID NO:80). To create a full-length cDNA transcript, exon 22 or exon 23 is spliced to the 5' end of the first coding exon—exon 1 (SEQ ID NO:33)—to form cDNAs containing coding sequences corresponding to any of the CDS structures diagramed in FIG. 1. Importantly, exons 22 and 23 are separated by 3 kilobasepairs in the genomic DNA (SEQ ID NO:28) and therefore are derived from separate promoters. It is likely that these promoters comprise important regulatory elements that impart tissue and/or temporal specificity to the distribution of TBC1D1 transcripts.

The present invention also relates to TBC1D1 agonists and antagonists and their use in treating obesity and diabetes. For example, (i) nucleic acid molecules encoding functional TBC1D1 protein; (ii) nucleic acids that are effective antisense, ribozyme, siRNA and triplex antagonists of nucleic acids encoding functional TBC1D1 protein; (iii) functional TBC1D1 proteins or peptides; (iv) anti-TBC1D1 antibodies; (v) small organic molecules affecting wild-type or mutant TBC1D1 function or TBC1D1 interaction with a TBC1D1 interactor, and preparations of such compositions, are disclosed herein. In addition, the invention provides drug discovery assays for identifying additional agents that agonize or antagonize the biological function of TBC1D1 protein (e.g. by altering the interaction of TBC1D1 molecules with either downstream or upstream elements in the biochemical (e.g. signal transduction pathway). Moreover, the present invention provides assays for diagnosing whether a subject has a predisposition towards developing obesity and/or diabetes.

Nucleic Acids and Proteins

The terms "polypeptide," "protein," and "peptide" are used herein interchangeably to refer to amino acid chains in which the amino acid residues are linked by peptide bonds or modified peptide bonds. The amino acid chains can be of any length of greater than two amino acids. Unless otherwise specified, the terms "polypeptide," "protein," and "peptide" also encompass various modified forms thereof. Such modified forms may be naturally occurring modified forms or chemically modified forms. Examples of modified forms include, but are not limited to, glycosylated forms, phosphorylated forms, myristoylated forms, palmitoylated forms, ribosylated forms, acetylated forms, etc. Modifications also include intra-molecular crosslinking and covalent attachment to various moieties such as lipids, flavin, biotin, polyethylene glycol or derivatives thereof, etc. In addition, modifications may also include cyclization, branching and cross-linking. Further, amino acids other than the conventional twenty amino acids encoded by genes may also be included in a polypeptide.

The terms "isolated", "substantially pure", and "substantially homogeneous" are used interchangeably to describe a protein or polypeptide that has been separated from components that accompany it in its natural state. A protein is substantially pure or isolated when at least about 20% by weight of the total protein content in a composition is the specified protein. However, the present invention also provides, in preferred embodiments, protein compositions containing a protein of the present invention at a content of at least 30%, 40%, 50%, 60%, 70%, 80% or 90% of the total proteins in the protein compositions on a weight-to-weight basis. Protein purity or homogeneity may be indicated by a number of means well known in the art, such as polyacrylamide gel electrophoresis of a protein sample, followed by visualizing a particular polypeptide band upon staining the gel. For certain purposes, higher resolution may be provided by using HPLC, capillary electrophoresis, or other means well known in the art which are utilized for protein purification.

The term "high stringency hybridization conditions," when used in connection with nucleic acid hybridization, means hybridization conducted overnight at 42° C. in a solution containing 50% formamide, 5×SSC (750 mM NaCl, 75 mM sodium citrate), 50 mM sodium phosphate, pH 7.6, 5×Denhardt's solution, 10% dextran sulfate, and 20 microgram/ml denatured and sheared salmon sperm DNA, with hybridization filters washed in 0.1×SSC at about 65° C. The term "moderate stringency hybridization conditions," when used in connection with nucleic acid hybridization, means hybridization conducted overnight at 37 degrees C. in a solution containing 50% formamide, 5×SSC (750 mM NaCl, 75 mM sodium citrate), 50 mM sodium phosphate, pH 7.6, 5×Denhardt's solution, 10% dextran sulfate, and 20 microgram/ml denatured and sheared salmon sperm DNA, with hybridization filters washed in 1×SSC at about 50° C. It is noted that many other hybridization methods, solutions and temperatures can be used to achieve comparably stringent hybridization conditions as will be apparent to skilled artisans.

For purposes of comparing two different nucleic acid or polypeptide sequences, one sequence (comparing sequence) may be described to be a specific "percent identical to" another sequence (reference sequence) in the present disclosure. In this respect, the percentage identity is determined by the algorithm of Karlin and Altschul, Proc. Natl. Acad. Sci. USA, 90:5873-5877 (1993), which is incorporated into the various BLAST programs. Specifically, the percentage identity is determined by the "BLAST 2 Sequences" tool, which is available on the world wide web at ncbi.nlm.nih.gov. See Tatusova and Madden, FEMS Microbiol. Lett., 174(2):247-250 (1999). For pairwise DNA-DNA comparison, the BLASTN 2.1.2 program is used with default parameters (Match: 1; Mismatch: -2; Open gap: 5 penalties; extension gap: 2 penalties; gap x_dropoff: 50; expect: 10; and word size: 11, with filter). For pairwise protein-protein sequence comparison, the BLASTP 2.1.2 program is employed using default parameters (Matrix: BLOSUM62; gap open: 11; gap extension: 1; x_dropoff: 15; expect: 10.0; and wordsize: 3, with filter).

As used herein, the term "interacting" or "interaction" means that two protein domains, fragments, or complete proteins exhibit sufficient physical affinity to each other so as to bring the two "interacting" protein domains, fragments, or proteins physically close to each other. An extreme case of interaction is the formation of a chemical bond that results in continual and stable proximity of the two domains or proteins. Interactions that are based solely on physical affinities, although usually more dynamic than chemically bonded interactions, can be equally effective in co-localizing two proteins. Examples of physical affinities and chemical bonds include, but are not limited to, forces caused by electrical charge differences, hydrophobicity, hydrogen bonds, Van der Waals forces, ionic forces, covalent linkages, and combinations thereof. The state of proximity between the interacting domains or entities may be transient or permanent, reversible or irreversible. In any event, it is in contrast to, and distinguishable from, contact caused by natural random movement of two entities. Typically although not necessarily, an "interaction" is exhibited by the binding between the interacting domains or entities. Examples of interactions include specific interactions between antigen and antibody, ligand and receptor, enzyme and substrate, and the like.

As used herein, two proteins or protein fragments are deemed to interact with each other when an interaction is detected using a yeast two-hybrid method and/or by co-immunoprecipitation.

Accordingly, the present invention provides isolated TBC1D1 nucleic acid molecules. The nucleic acid molecules can be in the form of DNA, RNA, or a chimera or hybrid thereof, and can be in any physical structures including single-stranded or double-stranded molecules, or in the form of a triple helices.

In one embodiment, the isolated TBC1D1 nucleic acid molecule has a sequence of SEQ ID NO:28, or some fragment, or collection of fragments, thereof. Conveniently, by way of examples, the isolated TBC1D1 nucleic acid molecule in accordance with this embodiment can be prepared by isolating genomic DNA from human cells or tissues, and cloning or amplifying the desired fragment or fragments.

In another embodiment, the isolated TBC1D1 nucleic acid molecule has a sequence of SEQ ID NOs:1, 11, 12, 13, 15, 17, 19, 21, 26, 29, 31, 81, 83, 85, 87, 89, 91, 93, 95, 97, 99, 101, 103, or 105, or the complement or ribonucleic acid equivalent thereof. Conveniently, by way of examples, the isolated TBC1D1 nucleic acid molecule in accordance with this embodiment can be prepared by isolating the TBC1D1 mRNA from human cells or tissues, or by reverse transcribing a TBC1D1 mRNA molecule and amplifying the resulting cDNA molecule.

In yet another embodiment, an isolated nucleic acid molecule is provided which has a sequence that is at least 50%, preferably at least 60%, more preferably at least 75%, 80%, 82%, 85%, even more preferably at least 90%, 91%, 92%, 93%, 94%, 95%, 96%, 97%, 98%, or 99% identical to the sequence of SEQ ID NOs: 1, 11, 12, 13, 15, 17, 19, 21, 26, 28, 29, 31, 81, 83, 85, 87, 89, 91, 93, 95, 97, 99, 101, 103, or 105, or the complement or ribonucleic acid equivalent thereof. Preferably, such nucleic acid molecules encode a polypeptide having the sequence of SEQ ID NOs:2, 14, 16, 18, 20, 22, 27, 30, 32, 82, 84, 86, 88, 90, 92, 94, 96, 98, 100, 102, 104, or 106.

In specific embodiments, nucleic acids are provided having at least a contiguous span of at least 2600, 2650, 2800, 3000, 3200 or 3504 nucleotides of SEQ ID NOs: 1, 11, 12, 13, 15, 17, 19, 21, 26, 28, 29, 31, 81, 83, 85, 87, 89, 91, 93, 95, 97, 99, 101, 103, or 105, or the complement or ribonucleic acid equivalent thereof.

As is apparent to skilled artisans, nucleic acids homologous to, or nucleic acids capable of hybridizing with, a nucleic acid of the sequence of SEQ ID NOs: 1, 11, 12, 13, 15, 17, 19, 21, 26, 28, 29, 31, 81, 83, 85, 87, 89, 91, 93, 95, 97, 99, 101, 103, or 105, or the complement or ribonucleic acid equivalent thereof, can be prepared by manipulating a TBC1D1 nucleic acid molecule having a sequence of SEQ ID NOs: 1, 11, 12, 13, 15, 17, 19, 21, 26, 28, 29, 31, 81, 83, 85, 87, 89, 91, 93, 95, 97, 99, 101, 103, or 105, or the complement or ribonucleic acid equivalent thereof. For example, various nucleotide substitutions, deletions or insertions can be incorporated into the TBC1D1 nucleic acid molecule by standard molecular biology techniques. As will be apparent to skilled artisans, such nucleic acids are useful irrespective of whether they encode a functional TBC1D1 protein. For example, they can be used as probes for isolating and/or detecting TBC1D1 nucleic acids. In certain embodiments, nucleic acids homologous to, or nucleic acids capable of hybridizing with, a nucleic acid of the sequence of SEQ ID NOs: 1, 11, 12, 13, 15, 17, 19, 21, 26, 28, 29, 31, 81, 83, 85, 87, 89, 91, 93, 95, 97, 99, 101, 103, or 105, encode a polypeptide having one or more TBC1D1 activities. In one embodiment, the proteins encoded by the nucleic acids contain a phosphotyrosine interacting domain (PID) and/or a TBC domain. In another embodiment, the proteins encoded by the nucleic acids contain one or more amino acid substitutions selected from the group consisting of R125W, V228G, and L392V. In a specific embodiment, the proteins contain both V228G and L392V substitutions. In another specific embodiment, the isolated nucleic acid molecules are naturally occurring allelic variants of the TBC1D1 gene nucleic acid. For example, such an isolated nucleic acid can have a nucleotide sequence according to SEQ ID NOs:13, 15, 17, 19, or 21.

In addition, nucleic acid molecules that encode the TBC1D1 protein having an amino acid sequence of SEQ ID NOs: 2, 14, 16, 18, 20, 22, 27, 30, 32, 82, 84, 86, 88, 90, 92, 94, 96, 98, 100, 102, 104, or 106, are also intended to fall within the scope of the present invention. As will be immediately apparent to a skilled artisan, due to genetic code degeneracy, such nucleic acid molecules can be designed conveniently by nucleotide substitutions in the wild-type TBC1D1 nucleotide sequence of SEQ ID NO:1 or TBC1D1 sequences according to SEQ ID NOs:13, 15, 17, 19, 21, 29, 31, 81, 83, 85, 87, 89, 91, 93, 95, 97, 99, 101, 103, or 105.

In addition, the present invention further encompasses nucleic acid molecules encoding a protein that has a sequence that is at least 75%, preferably at least 85%, 90%, 91%, 92%, 93%, or 94%, and more preferably at least 95%, 96%, 97%, 98%, or 99% identical to the sequence of SEQ ID NOs: 2, 14, 16, 18, 20, 22, 27, 30, 32, 82, 84, 86, 88, 90, 92, 94, 96, 98, 100, 102, 104, or 106. Preferably, the homologous protein retains one or more activities of TBC1D1. More preferably, the homologous protein contains a phosphotyrosine interacting domain (PID) and/or a TBC domain, or a fragment thereof. The various nucleic acid molecules may be provided by chemical synthesis and/or recombinant techniques based on an isolated TBC1D1 nucleic acid molecule having a sequence of SEQ ID NOs: 1, 11, 12, 13, 15, 17, 19, 21, 26, 28, 29, 31, 81, 83, 85, 87, 89, 91, 93, 95, 97, 99, 101, 103, or 105. In preferred embodiment, the protein has a sequence according to SEQ ID NOs: 14, 16, 18, 20, 22, 27, 30, 32, 82, 84, 86, 88, 90, 92, 94, 96, 98, 100, 102, 104, or 106.

The present invention also encompasses isolated nucleic acids encoding a TBC1D1 protein or a fragment thereof and having a sequence selected from (1) exons 11, 12, and 13, joined together, in that order, (2) exons 11, 33, 34, 12, and 13, joined together, in that order, (3) exons 11, 34, 12, and 13, joined together, in that order, (4) exons 11, 12, 36, and 13, joined together, in that order, (5) exons 11, 33, 34, 12, 36, and 13, joined together, in that order, (6) exons 11, 34, 12, 36 and 13, joined together, in that order, (7) exons 11, 33, 12, 36 and 13, joined together, in that order, (8) exons 11, 33, 12, and 13, joined together, in that order, (9) exons 11a, 12, and 13, joined together, in that order, (10) exons 11a, 33, 34, 12, and 13, joined together, in that order, (11) exons 11a, 34, 12, and 13, joined together, in that order, (12) exons 11a, 12, 36, and 13, joined together, in that order, (13) exons 11a, 33, 34, 12, 36, and 13, joined together, in that order, (14) exons 11a, 34, 12, 36 and 13, joined together, in that order, (15) exons 11a, 33, 12, 36 and 13, joined together, in that order, and (16) exons 11a, 33, 12, and 13, joined together, in that order. The full-length TBC1D1 protein, or any fragment thereof, comprising any of the sixteen combinations of exons described above also falls within the scope of the present invention.

In another embodiment of the present invention, oligonucleotides or TBC1D1 fragments are provided having a contiguous span of at least 18, 21, 22, 23, 24, 25, 26, 27, 28, 29, 30, 35, 50, 75, 100, 125, 150, 200, 250, 300, 350 or 400 nucleotides of the sequence of SEQ ID NOs: 1, 11, 12, 13, 15, 17, 19, 21, 26, 28, 29, 31, 33, 35, 37, 39, 41, 43, 45, 47, 49, 51, 53, 55, 57, 59, 61, 63, 65, 67, 69, 71, 73, 75, 77, 79 or 80, or the complement or ribonucleic acid equivalent thereof. In a preferred embodiment, the contiguous span includes, e.g., a sequence according to SEQ ID NO:5 or SEQ ID NO:6. In some other embodiments, the nucleic acids include a sequence according to SEQ ID NOs:3, 7, or 9. Preferably, the oligonucleotides are less than the full length of the sequence of SEQ ID NOs:1, 11, 12, 13, 15, 17, 19, 21, 26, 28, or complement or ribonucleic acid equivalent thereof. More preferably the oligonucleotides are no greater than 1,200, 1,000, 800, 600, 400, 200, 100, or 50 nucleotides in length. In a preferred embodiment, the oligonucleotides have a length of about 19-25, 26-34, 35-50, or 51-100 nucleotides. In other preferred embodiments, the oligonucleotides selectively hybridize, under moderate stringency hybridization conditions, to a nucleic acid having one, but not the others, of the sequences according to SEQ ID NOs:13, 15, 17, 19, 29, 31, 33, 35, 37, 39, 41, 43, 45, 47, 49, 51, 53, 55, 57, 59, 61, 63, 65, 67, 69, 71, 73, 75, 77, 79, 80, 81, 83, 85, 87, 89, 91, 93, 95, 97, 99, 101, 103 and 105. Preferably, in such preferred embodiments, the oligonucleotide includes a contiguous stretch of nucleotides of from 15, 16, 17, or 18 to 30, 40, or 50 nucleotides. In specific embodiments, such oligonucleotides can hybridize, under high or moderate stringency hybridization conditions, to a TBC1D1 nucleic acid having one or more mutations selected from C373T, T683G, C1174G (relative to SEQ ID NO:1) and equivalents thereof, or the complement of such a TBC1D1 nucleic acid, but not to TBC1D1 nucleic acids without such mutations (or the complements thereof). The term "equivalent" as used in this and other similar contexts means the equivalent nucleotide of C373T, T683G or C1174G, relative to SEQ ID NO:1, in other variant TBC1D1 nucleic acids (e.g., alternative spliced forms), although the exact number representing the location of the equivalent in the variant TBC1D1 nucleic acid may be different.

The present invention further encompasses oligonucleotides that have a length of at least 10, 12, 15, 17, 18, 19, 20, 21, 22, 23, 24, 25, 30, 35, 50, 75, 100, 125, 150, 200, 250, 300, 350 or 400 nucleotides, and are at least 85%, 90%, 92% or 94%, and more preferably at least 95%, 96%, 97%, 98%, or 99% identical to a contiguous span of nucleotides of the sequence of SEQ ID NOs:1, 11, 12, 13, 15, 17, 19, 21, 26 or 28, or the complement or ribonucleic acid equivalent thereof of the same length. Preferably, the oligonucleotides are no greater than 1,200, 1,000, 800, 600, 400, 200, 100, or 50 nucleotides. The oligonucleotides can have a length of about 12-18, 19-25, 26-34, 35-50, or 51-100 nucleotides. In a preferred embodiment, the oligonucleotides have a length of about 12-100, 15-75, 17-50, 21-50, or preferably 25-50 nucleotides. In one embodiment, the oligonucleotide is a sequence encoding a contiguous span of at least 4, 5, 6, 7, 8, 9, 10, 11, 12, 13, 14, 15, 16, 18, 20, 22, 25, 30, 35, 50, 75, 100, 125 or 150 amino acids of SEQ ID NOs:2, 14, 16, 18, 20, 22, 27, 30, 32, 82, 84, 86, 88, 90, 92, 94, 96, 98, 100, 102, 104, or 106. In another embodiment, the oligonucleotides include a mutant sequence according to SEQ ID NOs:23, 24, or 25, or the complement thereof.

As will be apparent to skilled artisans, the various oligonucleotides of the present invention are useful as probes for detecting TBC1D1 nucleic acids in cells and tissues. They can also be used as primers for procedures including the amplification of TBC1D1 nucleic acids, or homologues thereof, sequencing TBC1D1 nucleic acids, and detection of mutations in TBC1D1 nucleic acids, or homologues thereof. In addition, the oligonucleotides may be used to encode a fragment, epitope or domain of TBC1D1, or a homologue thereof, which is useful in a variety of applications including use as an antigenic epitope for preparing antibodies against TBC1D1.

It should be understood that the nucleic acid molecules of the present invention may be standard nucleic acids with conventional nucleotide bases and backbones, but can also be various modified forms of nucleic acids, or analogs thereof, e.g., having therein modified nucleotide bases or backbones.

In another embodiment, a hybrid or chimeric nucleic acid molecule is provided comprising any one of the above-described nucleic acid molecules of the present invention covalently linked to a non-TBC1D1 nucleic acid. In a specific embodiment, the present invention provides a vector comprising an insert of a TBC1D1 nucleic acid. Preferably, the vector is a DNA vector comprising as an insert of any one of the above-described nucleic acid molecules of the present invention. In a specific embodiment, the vector is an expression vector. Any suitable vectors may be used for purposes of the present invention. A typical expression vector should have a suitable promoter operably linked to a TBC1D1 nucleic acid of the present invention. The vectors of the present invention may be used to amplify the nucleic acid molecules of the present invention, or to introduce the nucleic acids into host cells. Such vectors may also be used for purposes of producing proteins encoded by the nucleic acids in a cell free system or in cells or tissues. Large amounts of the nucleic acids of the present invention may be produced by replication in a suitable host or transgenic animals. Constructs prepared for introduction into a prokaryotic or eukaryotic host may comprise a replication system recognized by the host, including the intended polynucleotide fragment encoding the desired polypeptide. Such constructs will preferably also include transcriptional and translational regulatory sequences operably linked to the polypeptide-encoding segment. Expression vectors may include, for example, an origin of replication or autonomously replicating sequence (ARS) and expression control sequences, a promoter, an enhancer and necessary functional sites, such as ribosome-binding sites, RNA splice sites, polyadenylation sites, transcriptional terminator sequences, and mRNA stabilizing sequences. Secretion signals may also be included where appropriate in order to allow the expressed protein to cross and/or lodge in cell membranes, and thus attain its functional topology, or be secreted from the cell. Such vectors may be prepared by means of standard recombinant techniques well known in the art.

Thus, the present invention further contemplates host cells into which any of the nucleic acid molecules of the present invention have been introduced from an exogenous source. The nucleic acid molecules of the present invention may be introduced into any type of suitable host cells, including, but not limited to, bacteria, yeast cells, plant cells, insect cells, and animal cells. The nucleic acid molecules of the present invention can be introduced exogenously into a host cell by any methods known in the art. When a nucleic acid molecule of the present invention is appropriately incorporated into a suitable expression vector and introduced into host cells, proteins may be recombinantly expressed within the host cells. Accordingly, the present invention also provides methods for recombinantly producing TBC1D1 protein, or fragments or homologues thereof, which includes the steps of introducing an expression vector containing a TBC1D1 nucleic acid molecule into a cell and expressing TBC1D1 in the host cell. The proteins expressed in this manner may be isolated and/or purified by standard purification techniques known in the art. Methods for making the host cells and recombinantly expressing TBC1D1 will be apparent to skilled artisans. Alternatively, an in vitro translation method can also be used in producing TBC1D1 protein, or homologues, derivatives, or fragments thereof. For example, a wheat germ extract system or rabbit reticulocyte lysate system may be used for in vitro translation, as will be apparent to a skilled person in the art.

In yet another embodiment of the present invention, a nucleic acid microchip or microarray is provided comprising one or more of the foregoing isolated nucleic acid molecules of the present invention. As is known in the art, with nucleic acid microchips a large number of nucleic acid molecules can be attached or immobilized in an array on a solid support, e.g., a silicon chip or glass slide. See Lipshutz et al., *Biotechniques,* 19:442-447 (1995); Chee et al., *Science,* 274:610-614 (1996); Kozal et al., *Nat. Med.* 2:753-759

(1996); Hacia et al., *Nat. Genet.*, 14:441-447 (1996); Saiki et al., *Proc. Natl. Acad. Sci. USA*, 86:6230-6234 (1989); Gingeras et al., *Genome Res.*, 8:435-448 (1998). The microchip technologies combined with computerized analysis tools allow for speedy high throughput screening and analysis. Various techniques for making and using nucleic acid microchips are known in the art and disclosed in, e.g., U.S. Pat. No. 5,925,525 to Fodor et al; Wilgenbus et al., *J. Mol. Med.*, 77:761-786 (1999); Graber et al., *Curr. Opin. Biotechnol.*, 9:14-18 (1998); Hacia et al., *Nat. Genet.*, 14:441-447 (1996); Shoemaker et al., *Nat. Genet.*, 14:450-456 (1996); DeRisi et al., *Nat. Genet.*, 14:457-460 (1996); Chee et al., *Nat. Genet.*, 14:610-614 (1996); Lockhart et al., *Nat. Genet.*, 14:675-680 (1996); Drobyshev et al., *Gene*, 188:45-52 (1997), all of which are incorporated herein by reference.

In a preferred embodiment, DNA molecules encoding TBC1D1, or a fragment or homologue thereof, or the complements or RNA equivalents of such DNA molecules, are included in a microarray of the present invention. More preferably, DNA molecules having a sequence according to the sequence of SEQ ID NOs:1, 3, 5, 7, 9, 11, 12, 13, 15, 17, 19, 21 23, 24, or 25, or the complement thereof, are incorporated into a microarray of the present invention. In specific embodiments, oligonucleotides are incorporated into the microchips having a contiguous stretch of from 15, 16, 17, or 18 to 30, 40, or 50 nucleotides. In specific embodiments, such oligonucleotides can hybridize, under high or moderate stringency hybridization conditions, to a TBC1D1 nucleic acid having one or more mutations selected from C373T, T683G, C1174G (relative to SEQ ID NO:1) and the equivalents or complement thereof, but not to TBC1D1 nucleic acids without such mutations, or the complements thereof.

In accordance with another aspect of the present invention, an isolated TBC1D1 polypeptide is provided. In one embodiment, the TBC1D1 polypeptide comprises the full sequence of SEQ ID NOs: 2, 14, 16, 18, 20, 22, 27, 30, 32, 82, 84, 86, 88, 90, 92, 94, 96, 98, 100, 102, 104, or 106.

Additionally, the present invention also encompasses a polypeptide having an amino acid sequence that is at least 50%, preferably at least 60%, more preferably at least 75%, 80%, 85%, 90%, 91%, 92%, 93%, 94%, and even more preferably at least 95%, 96%, 97%, 98%, or 99% identical to the amino acid sequence of SEQ ID NOs: 2, 14, 16, 18, 20, 22, 27, 30, 32, 82, 84, 86, 88, 90, 92, 94, 96, 98, 100, 102, 104, or 106. For example, polypeptides are provided comprising the sequence of SEQ ID NOs: 2, 14, 16, 18, 20, 22, 27, 30, 32, 82, 84, 86, 88, 90, 92, 94, 96, 98, 100, 102, 104, or 106 with no more than 1%, 2%, 3%, 4%, 5% or 10% amino acid deletions, insertions or substitutions. Preferably, any amino acid substitutions are conservative substitutions. Preferably, the homologous polypeptide retains one or more activities of TBC1D1. More preferably, the homologous polypeptide contains a PID domain and/or a TBC domain. In a specific embodiment, the homologous polypeptide is a naturally occurring variant of TBC1D1 identified in a human population. Such a variant may be identified by assaying the TBC1D1 nucleic acids or TBC1D1 protein in a population, as is generally known in the art. The nucleic acid variant thus identified can be isolated or alternatively produced by mutagenesis of the TBC1D1 nucleic acid of the sequence of SEQ ID NO:1. The TBC1D1 variant can then be prepared by recombinant expression using the nucleic acid variant as a template for transcription and translation.

The present invention further encompasses polypeptides having a contiguous span of at least 6, 7, 8, 9, 10, 11, 12, 13, 14, 15, 16, 17, 18, 19, 20, 25, 30, 35, 50, 75, 100, 125, 150, 200, 250, 300, 350, 400, 500, 600, 700, 800, 860, 900, preferably a contiguous span of from 6, 7, 8 or 9 to 10, 11, 12, 15 amino acids of the sequence of SEQ ID NOs: 2, 14, 16, 18, 20, 22, 27, 30, 32, 82, 84, 86, 88, 90, 92, 94, 96, 98, 100, 102, 104, or 106. For example, TBC1D1 fragments can be generated as a result of the deletion of a contiguous span of a certain number of amino acids from either or both of the amino and carboxyl termini of the TBC1D1 protein having the sequence of SEQ ID NOs: 2, 14, 16, 18, 20, 22, 27, 30, 32, 82, 84, 86, 88, 90, 92, 94, 96, 98, 100, 102, 104, or 106. In specific embodiments, the TBC1D1 fragments contain immunogenic or antigenic epitopes. Such epitopes can be readily predicted by computer programs such as MacVector from International Biotechnologies, Inc. and Protean/DNAStar from LaserGene, Inc. In addition, epitopes can also be selected experimentally by any methods known in the art, e.g., in U.S. Pat. Nos. 4,833,092 and 5,194,392, both of which are incorporated herein by reference.

In preferred embodiments, the present invention provides peptides comprising or consisting of a contiguous span of from 5, 6, 7, 8 or 9 to 10, 11, 12, 15, 20 amino acids of SEQ ID NO:16, having the amino acid substitution R125W; a contiguous span of from 5, 6, 7, 8 or 9 to 10, 11, 12, 15, 20 amino acids of SEQ ID NO:18, having the amino acid substitution V228G; and a contiguous span of from 5, 6, 7, 8 or 9 to 10, 11, 12, 15, 20 amino acids of SEQ ID NO:20, having the amino acid substitution L392V. Such peptides can be used as antigens to produce antibodies specific to mutant TBC1D1 proteins harboring such amino acid substitutions.

In addition, the present invention is also directed to polypeptides that are homologous to the foregoing TBC1D1 fragments. Such a homologous polypeptide may have the same length as one of the foregoing TBC1D1 fragments of the present invention (e.g., from 5 to 50, from 5 to 30, or from 7 to 25, or preferably 8 to 20 amino acids) but has an amino acid sequence that is at least 75%, 80%, 85%, 90%, preferably at least 95%, 96%, 97%, 98%, or, more preferably, at least 99% identical to the amino acid sequence of the corresponding TBC1D1 fragment. For example, polypeptides are provided with no more than 1%, 2%, 3%, 4%, 5% or 10% amino acid deletions, insertions or substitutions to the above-described TBC1D1 fragments. Preferably, any amino acid substitutions are conservative substitutions.

The protein fragments of the present invention may still retain the biological functions of TBC1D1 or one or more activities of TBC1D1. For example, such protein fragments may be immunogenic and thus can be used in producing antibodies against TBC1D1. The protein fragments may also be antigenic and thus can bind to an antibody specific against TBC1D1. In addition, where a protein fragment of the present invention lacks one or more TBC1D1 activities, it can be used as a competitive inhibitor of TBC1D1 activities by specifically competing with TBC1D1 protein for binding partners.

Additionally, the present invention further relates to a hybrid or chimeric polypeptide having any one of the foregoing polypeptides of the present invention covalently linked to another polypeptide. Such other polypeptides can also be one of the foregoing polypeptides of the present invention. Alternatively, such other polypeptides are not one of the foregoing polypeptides of the present invention. Preferably, such other polypeptides are non-TBC1D1 polypeptides.

Methods of Use

Diagnosis

Proof that any particular gene located within a genetically defined interval is a disease susceptability locus is obtained by finding sequences in DNA or RNA extracted from affected kindred members that create abnormal gene products or abnormal levels of gene product. Such disease susceptibility alleles will co-segregate with the disease in large kindreds. In identifying a disease susceptability locus, the key is to find polymorphisms or mutations that are serious enough to cause an obvious disruption to the normal function of the gene product. These mutations can take a number of forms. The most severe forms would be frameshift mutations or large deletions, which would cause the gene to code for an abnormal protein or would significantly alter protein expression. Less severe disruptive mutations would include small in-frame deletions and base pair substitutions which result in nonconservative amino acid substitutions in the encoded protein that would have a significant effect on the protein produced; such as changes to or from a cysteine residue, from a basic residue to an acidic residue or vice versa, from a hydrophobic to hydrophilic residue or vice versa, or other mutations which would affect secondary, tertiary or quaternary protein structure. Small deletions or base pair substitutions can also significantly alter protein expression by changing transcription levels, exon splicing patterns, mRNA stability, or translational efficiency of the gene transcript. Silent mutations—mutations resulting in conservative amino acid substitutions—would not generally be expected to disrupt protein function. Causal mutations that co-segregate with the disease phenotype can also be found in the promoter of the gene. These mutations can interfere with the binding of regulatory factors and in this way alter the transcription of the gene and therefore impact the function of the gene.

In one aspect, the invention features probes and primers for use in a prognostic or diagnostic assay. For instance, the present invention also provides a probe/primer comprising a substantially purified oligonucleotide, which oligonucleotide comprises a region of nucleotide sequence that hybridizes under high or medium stringent hybridization conditions or physiological conditions to at least approximately 12, 15, 17, 18, 19, 20, 21, 22, 23, 24, preferably 25, 26, 27, 28, 29, 30, more preferably 40, 50 or 75 consecutive nucleotides of sense or anti-sense sequence of TBC1D1, including 5' and/or 3' untranslated regions. Examples of TBC1D1 sequences from which such probes or primers can be derived include those according to SEQ ID NOs:1, 3, 5, 6, 7, 9, 11, 12, 13, 15, 17, 19, 21, 23, 24, 25, 26, 28, 29, 31, 81, 83, 85, 87, 89, 91, 93, 95, 97, 99, 101, 103 or 105. In certain embodiments, the probe/primer comprises a contiguous stretch of 12, 13, 14, 15, 16, 17 to 18, 19, 20, 21, 22, 23, 24, 25, 26, 27, 28, 29, 30, 40, 50, 60 or 70 nucleotides of SEQ ID NOs:15, 17, 19, and 21, and is capable of selectively hybrizing with a nucleic acid having the sequence of SEQ ID NOs:15, 17, 19, and 21, respectively, under high or moderate stringency hybridization conditions, or physiological conditions. That is, the probe/primer does not hybridize to a nucleic acid having a consensus wild-type nucleotide sequence, but hybridize to the mutant sequences discovered in obesity patients according to the present invention. In preferred embodiments, the probes/primers can have a contiguous stretch of 12, 13, 14, 15, 16, 17 to 18, 19, 20, 21, 22, 23, 24, 25, 26, 27, 28, 29, 30, 40, 50, 60 or 70 nucleotides of SEQ ID NOs:15, 17, 19, and 21, which spans one or more of the mutations according to the present invention, i.e., C373T, T683G, and/or C1174G. In other embodiments, the probes/primers can have a contiguous stretch of at least 12, 13, 14, 15, 16, 17, 18, 19, 20, 21, 22, 23, 24, 25, 26, 27, 28, 29, 30, 40, 50, 60 or 70 nucleotides of SEQ ID NO:26, which spans one or more of the mutations according to the present invention, i.e., C508G, T818G, and/or C1309G. For example, such selective hybridization probes can have a sequence according to SEQ ID NO:23, 24 or 25. In preferred embodiments, the probe further comprises a label group attached thereto and able to be detected, e.g. the label group is selected from amongst radioisotopes, fluorescent compounds, enzymes, and enzyme co-factors.

In a further aspect, the present invention features methods for determining whether a subject is at risk for developing obesity and/or diabetes. According to the diagnostic and prognostic methods of the present invention, alteration of the wild-type TBC1D1 locus is detected. "Alteration of a wild-type gene" encompasses all forms of mutations including deletions, insertions and point mutations in the coding and noncoding regions. Deletions may be of the entire gene or of only a portion of the gene. Point mutations may result in stop codons, frameshift mutations or amino acid substitutions. Point mutations or deletions in the promoter can change transcription and thereby impact gene function. Somatic mutations are those that occur only in certain tissues and are not inherited in the germline. Germline mutations can be found in any of a body's tissues and are inherited. The finding of TBC1D1 germline mutations thus provides diagnostic information. A TBC1D1 allele that is not deleted (e.g., is found on the sister chromosome to a chromosome carrying a TBC1D1 deletion) can be screened for other mutations, such as insertions, small deletions, substitutions and other point mutations. Events generating point mutations may occur in regulatory regions such as in the promoter of the gene, or in intronic regions, or at intron/exon junctions.

In one embodiment, the diagnostic/prognostic method includes a step of determining the presence or absence of an amino acid substitution, deletion, insertion, or protein truncation in the phosphotyrosine interacting domain (PID) of TBC1D1 protein of a patient, wherein the presence of such mutations would indicate an increased likelihood of, or predisposition to, obesity and/or diabetes. Such amino acid or protein changes can be detected at either the nucleotide sequence level or the amino acid sequence level, as will be apparent to ordinarily skilled artisans apprised of the present disclosure. Preferably, the diagnostic/prognostic method includes a step of determining the presence or absence of an amino acid substitution, deletion, insertion, or protein truncation in the phosphotyrosine interacting domain (PID) or the TBC domain of TBC1D1 protein that would affect the structure of the protein domains. The general structural features of PID domains are known in the art, and the important amino acid residues or sequences in the PID domain of TBC1D1 are readily recognizable. For example, the amino acid residues Arg125, Lys119, Ser112, Ser18, and Ser28 (relative to SEQ ID NO:2) can be critical to the PID domain's optimal interaction with phosphotyrosine. Non-conserved substitutions (e.g., charged to non-charged, positively charged to negatively charged, hydrophilic to hydrophobic, and vice versa) of any of these amino acids would indicate an increased likelihood of predisposition or diagnosis of obesity and/or diabetes. Amino acid changes that affect the TBC1D1 PID domain's binding of phosphotyrosine can also be readily identified without undue experimentation by, e.g., generating such changes in the TBC1D1

PID domain and testing its ability to bind phosphotyrosine or a phosphotyrosine-containing peptide (e.g., a peptide having the "NPxPY" consensus sequence).

In a specific embodiment, the diagnostic/prognostic method includes a step of determining the presence or absence of an R125W amino acid substitution in the TBC1D1 protein of a patient, wherein the presence of such a substitution would indicate an increased likelihood of, or predisposition to, obesity and/or diabetes. In a preferred embodiment, the presence or absence of a C373T nucleotide substitution is determined.

In another specific embodiment, the diagnostic/prognostic method includes a step of determining the presence or absence of a V228G amino acid substitution in the TBC1D1 protein of a patient, wherein the presence of such a substitution would indicate an increased likelihood of, or predisposition to, obesity and/or diabetes. In a preferred embodiment, the presence or absence of a T683G nucleotide substitution is determined.

In another specific embodiment, the diagnostic/prognostic method includes a step of determining the presence or absence of an L392V amino acid substitution in the TBC1D1 protein of a patient, wherein the presence of such a substitution would indicate an increased likelihood of, or predisposition to, obesity and/or diabetes. In a preferred embodiment, the presence or absence of a C1174G nucleotide substitution is determined.

In another preferred embodiment, the presence or absence of both V228G and L392V amino acid substitutions are determined, wherein the presence of both substitutions would indicate an increased likelihood of, or predisposition to, obesity and/or diabetes. In a preferred embodiment, the presence or absence of a T683G-C1174G haplotype is determined, wherein the presence of the T683G-C1174G haplotype would indicate an increased likelihood of, or predisposition to, obesity and/or diabetes.

Useful diagnostic techniques include, but are not limited to fluorescent in situ hybridization (FISH), direct DNA sequencing, PFGE analysis, Southern blot analysis, single stranded conformation analysis (SSCA), RNase protection assay, allele-specific oligonucleotide (ASO) hybridization, allele-specific amplification, dot blot analysis and PCR-SSCP, as discussed in detail further below. Also useful is the recently developed technique of DNA microchip technology. In addition to the techniques described herein, similar and other useful techniques are also described in U.S. Pat. Nos. 5,837,492 and 5,800,998, each of which are incorporated herein by reference.

Predisposition to disease can be ascertained by testing any tissue of a human for mutations of the TBC1D1 gene. For example, a person who has inherited a germline TBC1D1 mutation would be prone to develop obesity and/or diabetes. This can be determined by testing DNA from any tissue of the person's body. Most simply, blood can be drawn and DNA extracted from the cells of the blood. In addition, prenatal diagnosis can be accomplished by testing fetal cells, placental cells or amniotic cells for mutations of the TBC1D1 gene. Alteration of a wild-type TBC1D1 allele, whether, for example, by point mutation or deletion, can be detected by any of the means discussed herein.

There are several methods that can be used to detect DNA sequence variation. Direct DNA sequencing, either manual sequencing or automated fluorescent sequencing can detect sequence variation. Another approach is the single-stranded conformation polymorphism assay (SSCA) (Orita et al., 1989). This method does not detect all sequence changes, especially if the DNA fragment size is greater than 200 bp, but can be optimized to detect most DNA sequence variation. The reduced detection sensitivity is a disadvantage, but the increased throughput possible with SSCA makes it an attractive, viable alternative to direct sequencing for mutation detection on a research basis. The fragments that have shifted motilities on SSCA gels are then sequenced to determine the exact nature of the DNA sequence variation. Other approaches based on the detection of mismatches between the two complementary DNA strands include clamped denaturing gel electrophoresis (CDGE) (Sheffield et al., 1991), heteroduplex analysis (HA) (White et al., 1992) and chemical mismatch cleavage (CMC) (Grompe et al., 1989). None of the methods described above will detect large deletions, duplications or insertions, nor will they detect a regulatory mutation that affects transcription or translation of the protein. Other methods that might detect these classes of mutations such as a protein truncation assay or the asymmetric assay, detect only specific types of mutations and would not detect missense mutations. A discussion of currently available methods of detecting DNA sequence variation can be found in a review by Grompe (1993). Once a mutation is known, an allele specific detection approach such as allele-specific oligonucleotide (ASO) hybridization, or allele-specific amplification, can be utilized to rapidly screen large numbers of other samples for that same mutation.

Detection of point mutations may be accomplished by molecular cloning of the TBC1D1 allele(s) and sequencing the allele(s) using techniques well known in the art. Alternatively, the gene sequences can be amplified directly from a genomic DNA preparation from the tissue, using known techniques. The DNA sequence of the amplified sequences can then be determined.

There are at least six well known methods for a more complete, yet still indirect, test for confirming the presence of a susceptibility allele: 1) single-stranded conformation analysis (SSCA) (Orita et al., 1989); 2) denaturing gradient gel electrophoresis (DGGE) (Wartell et al., 1990; Sheffield et al., 1989); 3) RNase protection assays (Finkelstein et al., 1990; Kinszler et al., 1991); 4) allele-specific oligonucleotides (ASOs) (Conner et al., 1983); 5) the use of proteins which recognize nucleotide mismatches, such as the *E. coli* mutS protein (Modrich, 1991); and 6) allele-specific PCR (Rano and Kidd, 1989). For allele-specific PCR, primers are used which only hybridize at their 3' ends to templates bearing a particular TBC1D1 mutation. If the particular TBC1D1 mutation is not present, an amplification product is not observed. Amplification Refractory Mutation System (ARMS), as disclosed in European Patent Application Publication No. 0332435 and in Newton et al., 1989, can also be used. Insertions and deletions of portions of genes can also be detected by cloning, sequencing and amplification. In addition, restriction fragment length polymorphism (RFLP) probes for the gene or surrounding marker genes can be used to score an alteration of an allele or an insertion in a polymorphic fragment. Such methods are particularly useful for screening relatives of an affected individual for the presence of the TBC1D1 mutation found in that individual. Other techniques for detecting insertions and deletions as known in the art can be used.

In the first three methods (SSCA, DGGE and RNase protection assay), a new electrophoretic band appears when a mutation is present. SSCA detects a band which migrates differentially because the sequence change causes a difference in single-strand, intramolecular base pairing. RNase protection involves cleavage of the mutant polynucleotide into two or more smaller fragments. DGGE detects differences in migration rates of mutant sequences compared to wild-type sequences, using a denaturing gradient gel. In an allele-specific oligonucleotide assay, an oligonucleotide is designed which detects a specific sequence, and the assay is performed by detecting the presence or absence of a hybridization signal. In the mutS assay, the mutS protein binds only to sequences that contain a nucleotide mismatch in a heteroduplex between mutant and wild-type sequences.

Mismatches, according to the present invention, are hybridized nucleic acid duplexes in which the two strands are not 100% complementary. Lack of total homology may be due to deletions, insertions, inversions or substitutions. Mismatch detection can be used to detect point mutations in the gene or in its mRNA product. While these techniques are generally less sensitive than sequencing, they are simpler to perform on a large number of samples. An example of a mismatch cleavage technique is the RNase protection method. In the practice of the present invention, the method involves the use of a labeled riboprobe, which is complementary to the human wild-type TBC1D1 gene coding sequence. The riboprobe and either mRNA or DNA isolated from the tumor tissue are annealed (hybridized) together and subsequently digested with the enzyme RNase A, which is able to detect some mismatches in a duplex RNA structure. If a mismatch is detected by RNase A, it cleaves at the site of the mismatch. Thus, when the annealed RNA preparation is separated on an electrophoretic gel matrix, if a mismatch has been detected and cleaved by RNase A, an RNA product will be seen which is smaller than the full length duplex RNA for the riboprobe and the mRNA or DNA. The riboprobe need not be the full length of the TBC1D1 mRNA or gene but can be a segment of either. If the riboprobe comprises only a segment of the TBC1D1 mRNA or gene, it is desirable to use a number of these probes to screen the whole mRNA sequence for mismatches.

In a similar fashion, DNA probes can be used to detect mismatches, through enzymatic or chemical cleavage. See, e.g., Cotton et al., 1988; Shenk et al., 1975; Novack et al., 1986. Alternatively, mismatches can be detected by shifts in the electrophoretic mobility of mismatched duplexes relative to matched duplexes. See, e.g., Cariello, 1988. With either riboprobes or DNA probes, the cellular mRNA or DNA that might contain a mutation can be amplified using PCR before hybridization. Changes in DNA of the TBC1D1 gene can also be detected using Southern hybridization, especially if the changes are gross rearrangements, such as deletions, insertions and inversions.

DNA sequences of the TBC1D1 gene, which have been amplified by use of PCR, may also be screened using allele-specific probes. These probes are nucleic acid oligomers, each of which contains a region of the TBC1D1 gene sequence harboring a known mutation. For example, one oligomer may be about 30 nucleotides in length (although shorter and longer oligomers are also usable, as well recognized by those of skill in the art), corresponding to a portion of the TBC1D1 gene sequence. By use of a battery of such allele-specific probes, PCR amplification products can be screened to identify the presence of a previously identified mutation in the TBC1D1 gene. Hybridization of allele-specific probes with amplified TBC1D1 sequences can be performed, for example, on a nylon filter. Hybridization to a particular probe under high stringency hybridization conditions indicates the presence of the same mutation in the nucleic acids of the sample as in the allele-specific probe.

The newly developed technique of nucleic acid analysis via microchip technology is also applicable to the present invention. In this technique, literally thousands of distinct oligonucleotide probes are built up in an array on a silicon chip. The nucleic acid to be analyzed is fluorescently labeled and hybridized to the probes on the chip. It is also possible to study nucleic acid-protein interactions using these nucleic acid microchips. Using such techniques one can determine the presence of mutations or even sequence the nucleic acid being analyzed, or one can measure expression levels of a gene of interest. Advantages of the method include the parallel processing of many, even thousands, of probes at once, which can tremendously increase the rate of analysis and sample throughput. Microchip technologies have been described in publications by Hacia et al., 1996; Shoemaker et al., 1996; Chee et al., 1996; Lockhart et al., 1996; DeRisi et al., 1996; Lipshutz et al., 1995. Microchip-based methods have already been used to screen humans for mutations in the breast cancer gene BRCA1 (Hacia et al., 1996), and the technology has been reviewed in a news article in Chemical and Engineering News (Borman, 1996) and has been the subject of an editorial (Nature Genetics, 1996). Also see Fodor (1997).

The most definitive test for mutations in a candidate locus is to directly compare genomic TBC1D1 sequences from disease patients with those from a control population. Alternatively, one could sequence mRNA after reverse transcription and amplification, e.g., by RT-PCR, thereby eliminating the necessity of determining the exon structure of the candidate gene.

Mutations in disease patients falling outside the TBC1D1 CDS of can be detected by examining the non-coding regions, within and around the TBC1D1 gene. Such mutations can occur within introns, promoter regions, and regulatory sequences within or near the TBC1D1 gene. An early indication that mutations in noncoding regions are important may come from Northern blot experiments that reveal mRNA molecules of abnormal size or abundance in disease patients as compared to control individuals. In one embodiment, an intron/exon junction region of a TBC1D1 gene is analyzed, e.g., by PCR amplification followed by sequencing, to determine the presence or absence of a mutation that results in altered mRNA splicing, which in turn causes a substantial change in the encoded TBC1D1 protein. Examples of such a substantial change include, e.g., premature translation termination, codon frameshift, large deletions of amino acid sequences, etc. Since the consensus intron/exon junction sequences are well known in the art, mutations in an intron/exon junction of a subject TBC1D1 gene can be readily identified by comparison and the resulting consequences of the mutations can be recognized.

Alteration of TBC1D1 mRNA expression can be detected by any techniques known in the art. These include Northern blot analysis, quantitative RT-PCR and RNase protection. Diminished or increased mRNA expression indicates an alteration of the wild-type TBC1D1 gene. Alterations of wild-type TBC1D1 genes can also be detected by screening for alterations of wild-type TBC1D1 proteins. For example, monoclonal antibodies immunoreactive with TBC1D1 can be used to screen a tissue. Lack of a particular cognate antigen would indicate a TBC1D1 mutation. Antibodies specific for products of mutant alleles could also be used to detect mutant TBC1D1 gene products. Such immunological assays can be done in any convenient formats known in the art. These include Western blots, immunohistochemical assays, and enzyme linked immunosorbant assays (ELISAs) or enzyme linked immunofiltration assays (ELIFAs). Any means for detecting an altered TBC1D1 protein can be used to detect alteration of wild-type TBC1D1 genes. Functional assays, such as protein binding determinations, can be used. In addition, assays can be used which detect TBC1D1 biochemical function. Finding a mutant TBC1D1 gene product indicates alteration of the wild-type TBC1D1 gene.

Allele-specific primers can also be used to identify specific mutant alleles of the TBC1D1 gene. Such primers anneal only to particular TBC1D1 mutant alleles, and thus will only amplify a product when the mutant allele is present as a template.

The nucleic acid probes provided by the present invention are useful for a number of purposes. They can be used in Southern hybridization to genomic DNA and in the RNase protection method for detecting the point mutations discussed above. The probes can also be used to detect PCR amplification products. They may also be used to detect mismatches with the TBC1D1 gene, mRNA or cDNA using other techniques.

It has been discovered that individuals with the wild-type TBC1D1 gene do not have obesity that results from the TBC1D1 allele. However, mutations that affect the function of the TBC1D1 protein are involved in the susceptability to obesity as shown herein. Thus, the presence of an altered (or a mutant) TBC1D1 gene, which produces a protein having an altered function, directly correlates to an increased risk of disease. In order to detect a TBC1D1 gene mutation, a biological sample is prepared and analyzed for a difference between the sequence of the TBC1D1 allele being analyzed and the sequence of the wild-type TBC1D1 allele. Mutant TBC1D1 alleles can be initially identified by any of the techniques described above. The mutant alleles are then sequenced to identify or confirm the specific mutation of the particular mutant allele. Alternatively, mutant TBC1D1 alleles can be initially identified by identifying mutant (altered) TBC1D1 proteins, using conventional techniques, e.g., protein truncation test. cDNA or genomic DNA can then be sequenced to identify the specific mutation responsible for the mutant protein. The mutations, especially those that lead to an altered function of the TBC1D1 protein, are used for the diagnostic methods of the present invention.

The present invention employs definitions and nomenclature commonly used in the art with specific reference to the gene described in the present application. Such definitions can be found in U.S. Pat. Nos. 5,837,492; 5,800,998; 6,261,801; 6,274,720 and 6,274,376, and in Antonarakis et al. (*Human Mutation* 11: 1-3 (1998)), each of which are incorporated herein by reference. Such definitions are employed herein unless the context indicates otherwise.

In order to detect the presence of a TBC1D1 allele predisposing an individual to obesity and/or diabetes, a biological sample such as blood is prepared and analyzed for the presence or absence of predisposing alleles of TBC1D1. Results of these tests and interpretive information are returned to the health care provider for communication to the tested individual. The results can be transformed into a data set including data and information defining the identity or characteristics of the TBC1D1 gene of the tested individual. The data set may include information relating to the nucleotide sequence of the TBC1D1 gene and/or amino acid sequence encoded by the gene, or relative TBC1D1 mRNA or protein expression levels. Alternatively, the data set may simply include alterations in the TBC1D1 gene or protein, or an indication of the presence or absence of any disease-predisposing mutations, and optionally, a description of the specific disease-predisposing mutation(s). Examples of specific predisposing mutations are described above. The data or information can be cast in a transmittable form that can be communicated or transmitted to another clinical laboratory, physicians or health care providers, or directly to patients. Such a transmittable form can vary and can be of tangible manufactures. For example, the data set can be embodied in texts, tables, diagrams, photographs, charts, images or any other visual forms. The data or information can be recorded on a tangible medium such as paper or embodied in computer-readable forms (e.g., electronic, electromagnetic, optical or other signals) by computer readable program codes. The data in a computer-readable form can be stored in a computer usable storage medium (e.g., floppy disks, magnetic tapes, optical disks, and the like) or transmitted directly through a communication infrastructure. In particular, the data embodied in electronic signals can be transmitted in the form of e-mail or posted on a secure access website on the Internet or an Intranet. In addition, the information or data can also be recorded in an audible form and transmitted through any suitable media, e.g., analog or digital cable lines, fiber optic cables, etc., via telephone, facsimile, wireless mobile phone, Internet phone and the like.

Diagnoses may be performed by diagnostic laboratories, or, alternatively, diagnostic kits are manufactured and sold to health care providers or to private individuals for self-diagnosis. Diagnostic or prognostic tests can be performed as described herein or using well-known techniques, such as described in U.S. Pat. No. 5,800,998, incorporated herein by reference.

Initially, the screening method involves amplification of the relevant TBC1D1 sequences by the Polymerase Chain Reaction (PCR). In another preferred embodiment of the invention, the screening method involves a non-PCR based strategy. Such screening methods include two-step label amplification methodologies that are well known in the art. Both PCR and non-PCR based screening strategies can detect target sequences with a high level of sensitivity.

The most popular methods used today generally involve target amplification. Here, the target nucleic acid sequence is amplified with polymerases. One particularly preferred method using polymerase-driven amplification is PCR. PCR and other polymerase-driven amplification assays can achieve over a million-fold increase in copy number through the use of polymerase-driven amplification cycles. Once amplified, the resulting nucleic acid can be sequenced or used as a substrate for DNA probes.

When the probes are used to detect the presence of the target sequences or specific mutant alleles of those target sequences (for example, in screening for obesity susceptibility), the biological sample to be analyzed, such as blood or serum, may be treated, if desired, to extract the nucleic acids. The sample nucleic acid may be prepared in various ways to facilitate detection of the target sequence; e.g. denaturation, restriction digestion, electrophoresis or dot blotting. The targeted region of the analyte nucleic acid usually must be at least partially single-stranded to form hybrids with the targeting sequence of the probe. If the sequence is naturally single-stranded, denaturation will not be required. However, if the sequence is double-stranded, the sequence will probably need to be denatured. Denaturation can be carried out by various techniques known in the art.

Analyte nucleic acid and probe are incubated under conditions that promote stable hybrid formation of the target sequence in the probe with the putative targeted sequence in the analyte. The region of the probes, which is used to bind to the analyte, can be made completely complementary to the targeted region of human chromosome 4. Therefore, high stringency conditions are desirable in order to prevent false positives. However, conditions of high stringency are used only if the probes are complementary to regions of the chromosome that are unique in the genome. The stringency of hybridization is determined by a number of factors during hybridization and during the washing procedure, including temperature, ionic strength, base composition, probe length, and concentration of formamide. These factors are outlined in, for example, Maniatis et al., 1982 and Sambrook et al., 1989. Under certain circumstances, the formation of higher order hybrids, such as triplexes, quadraplexes, etc., may be desired to provide the means of detecting target sequences.

Detection, if any, of the resulting hybrid is usually accomplished by the use of labeled probes. Alternatively, the probe may be unlabeled, but may be detectable by specific binding with a ligand that is labeled, either directly or indirectly. Suitable labels, and methods for labeling probes and ligands are known in the art, and include, for example, radioactive labels which may be incorporated by known methods (e.g., nick translation, random priming or phosphorylation by kinases), biotin, fluorescent groups, chemiluminescent groups (e.g., dioxetanes, particularly triggered dioxetanes), enzymes, antibodies and the like. Variations of this basic scheme are known in the art, and include those variations that facilitate separation of the hybrids to be detected from extraneous materials and/or that amplify the signal from the labeled moiety. A number of these variations are reviewed in, e.g., Matthews and Kricka, 1988; Landegren et al., 1988; Mittlin, 1989; U.S. Pat. No. 4,868,105, and in EPO Publication No. 225,807.

As noted above, non-PCR based screening assays are also contemplated in this invention. This procedure calls for the hybridization of a nucleic acid probe (or an analog such as a methyl phosphonate backbone replacing the normal phosphodiester), to the low level DNA target. This probe may have an enzyme covalently linked to it, such that the covalent linkage does not interfere with the specificity of hybridization. This enzyme-probe-conjugate-target nucleic acid complex can then be isolated away from the free probe-enzyme-conjugate and a substrate is added for enzyme detection. Enzymatic activity is observed as a change in color development or luminescent output resulting in a $10^3$-$10^6$ increase in sensitivity. For an example relating to the preparation of oligodeoxynucleotide-alkaline phosphatase conjugates and their use as hybridization probes see Jablonski et al., 1986.

Two-step label amplification methodologies are known in the art. These assays work on the principle that a small ligand (such as digoxigenin, biotin, or the like) is attached to a nucleic acid probe capable of specifically binding a wild type TBC1D1 allele. Mutant allele specific probes are also contemplated within the scope of this example and exemplary mutant allele specific probes include probes encompassing the predisposing or potentially predisposing mutations summarized herein.

In one example, the small ligand attached to the nucleic acid probe is specifically recognized by an antibody-enzyme conjugate. In one embodiment of this example, digoxigenin is attached to the nucleic acid probe. Hybridization is detected by an antibody-alkaline phosphatase conjugate that reacts with a chemiluminescent substrate and produces a luminescent signal. For methods for labeling nucleic acid probes according to this embodiment see Martin et al., 1990. Alternatively, hybridization may be detected by an antibody-alkaline phosphatase conjugate that reacts with a chemifluorescent substrate which, when cleaved, generates a fluorescent dye that is detected by fluorescence scanning. In another example, the small ligand is recognized by a second ligand-enzyme conjugate that is capable of specifically complexing to the first ligand. A well-known embodiment of this example is the biotin-avidin type of interactions. For methods for labeling nucleic acid probes and their use in biotin-avidin based assays see Rigby et al., 1977 and Nguyen et al., 1992.

It is also contemplated within the scope of this invention that the nucleic acid probe assays of this invention will employ a cocktail of nucleic acid probes capable of detecting wild type alleles of TBC1D1. Thus, in one example, to detect the presence of wild type alleles of TBC1D1 in a cell sample, more than one probe complementary to TBC1D1 is employed and in particular the number of different probes is alternatively 2, 3, or 5 different nucleic acid probe sequences. In another example, to detect the presence of mutations in the TBC1D1 gene sequence in a patient, more than one probe complementary to TBC1D1 is employed where the cocktail includes probes capable of binding to the allele-specific mutations identified in populations of patients with alterations in TBC1D1. In this embodiment, any number of probes can be used, and will preferably include probes corresponding to the major gene mutations identified as predisposing an individual to obesity. Some candidate probes contemplated within the scope of the invention include probes that include the allele-specific mutations identified herein and those that have the TBC1D1 regions corresponding to SEQ ID NOs:13, 15, 17, 19 and 21, both 5' and 3' to the mutation site.

Susceptibility to obesity and/or diabetes can also be detected on the basis of the alteration of wild-type TBC1D1 polypeptide. Peptide diagnostic or prognostic tests can be performed as described herein or using well-known techniques, such as described in U.S. Pat. No. 5,800,998, incorporated herein by reference. For example, such alterations can be determined by amino acid sequence analysis in accordance with conventional techniques. More preferably, antibodies (polyclonal or monoclonal) are used to detect differences in, or the absence of, TBC1D1 peptides. The antibodies may be prepared in accordance with conventional techniques. Other techniques for raising and purifying antibodies are well known in the art and any such techniques may be chosen to achieve the preparations claimed in this invention. In a preferred embodiment of the invention, antibodies will immunoprecipitate TBC1D1 proteins, or fragments of the TBC1D1 protein, from solution, as well as react with TBC1D1 peptides on Western or immunoblots of polyacrylamide gels. In another preferred embodiment, antibodies will detect TBC1D1 proteins and protein fragments in paraffin or frozen tissue sections, using immunocytochemical techniques.

Preferred embodiments relating to methods for detecting TBC1D1 or mutant forms thereof include ELISA, ELIFA, radioimmunoassays (RIA), immunoradiometric assays (IRMA) and immunoenzymatic assays (IEMA), including sandwich assays using monoclonal and/or polyclonal antibodies. Exemplary sandwich assays are described by David et al. in U.S. Pat. Nos. 4,376,110 and 4,486,530, hereby incorporated by reference.

Alteration of TBC1D1 expression levels may also be detected using antibodies or other methods described above.

In specific embodiments, the presence or absence of amino acid substitutions R125W, V228G, or L392V is detected, either individually or collectively. In certain preferred embodiments, antibodies may be used to detect and quantitate mutant forms of TBC1D1.

The present invention also provides a kit for predicting, in an individual, the effective response to antiobesity drugs.

The kit may include a carrier for the various components of the kit. The carrier can be a container or support, in the form of, e.g., bag, box, tube, or rack, which is optionally compartmentalized. The carrier may define an enclosed confinement for safety purposes during shipment and storage. The kit also includes various components useful in detecting the nucleotide or amino acid variants discovered in accordance with the present invention using any of the above-discussed detection techniques.

In one preferred embodiment, the detection kit includes one or more oligonucleotides useful in detecting the C373T, T683G, and/or C1174G genetic variants in the TBC1D1 gene sequence. Preferably, the oligonucleotides are designed such that they hybridize only to a TBC1D1 gene sequence containing the particular variants discovered in accordance with the present invention, under high or moderate stringency conditions. Thus, the oligonucleotides can be used in mutation-detecting techniques such as allele-specific oligonucleotides (ASO), allele-specific PCR, TaqMan, chemiluminescence-based techniques, molecular beacons, and improvements or derivatives thereof, e.g., microchip technologies. The oligonucleotides in this embodiment preferably have a nucleotide sequence that matches a nucleotide sequence of the mutant TBC1D1 gene allele containing the specific genetic variant to be detected. The nucleotide variant preferably is not located at the 5' or 3' end, but in other positions in the oligonucleotides. The length of the oligonucleotides in accordance with this embodiment of the invention can vary depending on its nucleotide sequence and the hybridization conditions employed in the detection procedure. Preferably, the oligonucleotides contain from about 10 nucleotides to about 100 nucleotides, more preferably from about 15 to about 75 nucleotides. Under certain conditions, a length of 18 to 30 may be optimum. In any event, the oligonucleotides should be designed such that they can be used in distinguishing one genetic variant from another at a particular locus under predetermined stringent hybridization conditions. The hybridization of an oligonucleotide with a nucleic acid and the optimization of the length and hybridization conditions should be apparent to a person of skill in the art. See generally, Sambrook et al., *Molecular Cloning: A Laboratory Manual*, 2$^{nd}$ ed., Cold Spring Harbor Laboratory, Cold Spring Harbor, N.Y., 1989. Notably, the oligonucleotides in accordance with this embodiment are also useful in mismatch-based detection techniques described above, such as electrophoretic mobility shift assay, RNase protection assay, mutS assay, etc.

In another embodiment of this invention, the kit includes one or more oligonucleotides suitable for use in detecting techniques such as ARMS, oligonucleotide ligation assay (OLA), and the like. The oligonucleotides in this embodiment include a TBC1D1 gene sequence immediately 5' upstream from the genetic variant to be analyzed. The 3' end nucleotide is a nucleotide variant in accordance with this invention.

The oligonucleotides in the detection kit can be labeled with any suitable detection marker including but not limited to, radioactive isotopes, fluorophores, biotin, enzymes (e.g., alkaline phosphatase), enzyme substrates, ligands and antibodies, etc. See Jablonski et al., *Nucleic Acids Res.*, 14:6115-6128 (1986); Nguyen et al., *Biotechniques*, 13:116-123 (1992); Rigby et al., *J. Mol. Biol.*, 113:237-251 (1977). Alternatively, the oligonucleotides included in the kit are not labeled, and instead, one or more markers are provided in the kit so that users may label the oligonucleotides at the time of use.

In another embodiment of the invention, the detection kit contains one or more idiotype-specific antibodies, i.e., antibodies that only recognize certain TBC1D1 proteins or polypeptides containing one or more amino acid substitutions of R125W, V228G and L392V. Methods for producing and using such antibodies should be apparent to skilled artisans.

Various other components useful in the detection techniques may also be included in the detection kit of this invention. Examples of such components include, but are not limited to, Taq polymerase, deoxyribonucleotides, dideoxyribonucleotides other primers suitable for the amplification of a target DNA sequence, RNase A, mutS protein, and the like. In addition, the detection kit preferably includes instructions on using the kit for detecting the nucleotide substitutions or amino acid substitutions in TBC1D1 gene or protein, respectively.

Methods of Use

Drug Screening

Polypeptides of the invention also may be used to assess the binding of small molecule substrates and ligands in, for example, cells, cell-free preparations, chemical libraries, and natural product mixtures. These substrates and ligands may be natural substrates and ligands or may be structural or functional mimetics. See, e.g., Coligan et al., *Current Protocols in Immunology* 1(2):Chapter 5 (1991). Thus, the invention also provides a method of screening compounds to identify those that enhance (agonist) or block (antagonist) the action of TBC1D1 polypeptides or polynucleotides, particularly those compounds potentially useful for treating or preventing obesity and diabetes.

This invention is particularly useful for screening compounds by using a wild type or mutant TBC1D1 polypeptide, or binding fragment thereof, in any of a variety of drug screening techniques. Drug screening can be performed as described herein or using well known techniques, such as described in U.S. Pat. Nos. 5,800,998 and 5,891,628, each of which are incorporated herein by reference.

The TBC1D1 polypeptide or fragment employed in such a test may either be free in solution, affixed to a solid support, or borne on a cell surface. One method of drug screening utilizes eukaryotic or prokaryotic host cells which are stably transformed with recombinant polynucleotides expressing the polypeptide or fragment, preferably in competitive binding assays. Such cells, either in viable or fixed form, can be used for standard binding assays. One may measure, for example, the formation of complexes between a TBC1D1 polypeptide or fragment and the agent being tested, or examine the degree to which the formation of a complex between a TBC1D1 polypeptide or fragment and a known ligand, e.g. a TBC1D1 interactor, is interfered with by the agent being tested. For example, because TBC1D1 has a PID domain, compounds can be screened to identify modulators of the binding of the PID domain to phosphotyrosine or phosphotyrosine-containing proteins.

Thus, the present invention provides methods of screening test agents for drug candidates. Such methods comprise contacting such test agents with a TBC1D1 polypeptide, or a fragment thereof, or a complex containing the TBC1D1 polypeptide, or a fragment thereof, and a binding ligand or partner protein, and assaying for the presence of a complex formed between either (a) the test agent and the TBC1D1 polypeptide or fragment, or (b) the TBC1D1 polypeptide or fragment, and the ligand or partner protein. Methods of detecting such complexes can be any of those well known in the art of drug screening, but preferred methods include fluorescence polarization or fluorescent resonance energy transfer. In such competitive binding assays the TBC1D1 polypeptide, or a fragment thereof, is typically labeled, and the binding ligand can be immobilized. In assays involving competitive binding of ligands or partner proteins, the TBC1D1 polypeptide, or fragment thereof, is allowed to reach equilibrium with a binding partner in the presence and absence of a test compound. The free TBC1D1 polypeptide, or fragment thereof, is then separated from that present in a TBC1D1:ligand complex, and the amount of free (i.e., uncomplexed) TBC1D1 serves as a means to measure the ability of the test agent to interfere with TBC1D1 ligand binding.

Another technique used for drug screening provides high throughput screens for compounds having suitable binding affinity to TBC1D1 polypeptides and is described in detail in Geysen, PCT application publication WO 84/03564. Briefly stated, large numbers of different small peptide test compounds are synthesized on a solid substrate, such as plastic pins or some other surface. The immobilized peptide test compounds are reacted with TBC1D1 polypeptides in solution and are subsequently washed. Bound TBC1D1 polypeptides are then detected by methods well known in the art.

Alternatively, TBC1D1, or fragments thereof, can be immobilized on a solid phase and used for drug screening protocols. For these purposes, purified TBC1D1 can be coated directly onto plates. However, non-neutralizing antibodies to TBC1D1 can be used to capture specific antibodies to immobilize TBC1D1, or fragments thereof, on a solid phase.

This invention also contemplates the use of competitive drug screening assays in which neutralizing antibodies capable of specifically binding the TBC1D1 polypeptide compete with a test compound for binding to the TBC1D1 polypeptide, or fragments thereof. In this manner, the antibodies can be used to detect the presence of any peptide that shares one or more antigenic determinants of the TBC1D1 polypeptide.

A further technique for drug screening involves the use of host eukaryotic cell lines or cells (such as described above) that express a wild type or mutant TBC1D1 gene and, as a consequence of expression of wild type or mutant TBC1D1, demonstrate a specific phenotype. The phenotype of the cells is examined to determine if the compound is capable of modulating that phenotype, thereby indicating that the compound affects TBC1D1 function.

Briefly, a method of screening for a substance which modulates an activity of a polypeptide may include contacting one or more test substances with the polypeptide in a suitable reaction medium, testing the activity of the treated polypeptide and comparing that activity with the activity of the polypeptide in comparable reaction medium untreated with the test substance or substances. A difference in activity between the treated and untreated samples indicates that the test substance or substances modulates the activity ot the polypeptide.

For example, it has been discovered that overexpression of TBC1D1 in certain eukaryotic cell types (e.g., *Saccharomyces cerevisiae* cells) causes cell death. Consequently, one method of screening for substances that modulate the activity of TBC1D1 would be to screen for the rescue of toxicity in cells overexpressing TBC1D1. This type of screen has been conducted using *S. cerevisiae* cells and has identified several potential lead compounds, which will be tested in human cell models, and possibly whole animal models for obesity and/or diabetes.

Prior to, or simultaneous with, being screened for their ability to modulate an activity of TBC1D1, test substances—especially peptides or peptide mimetics—may be screened for their ability to directly interact with TBC1D1 polypeptides, e.g., in a yeast two-hybrid system (e.g., Bartel et al., 1993; Fields and Song, 1989; Chevray and Nathans, 1992; Lee et al., 1995). The yeast two-hybrid system may be used as a rapid screen for binding activity prior to testing a substance for its ability to modulate an activity of TBC1D1. Alternatively, a yeast two-hybrid screen could be used to screen test substances for their ability to bind a TBC1D1-specific binding partner, or to act as a mimetics of a TBC1D1 polypeptide.

Methods of Use

Rational Drug Design

The goal of rational drug design is to produce structural analogs of biologically active polypeptides of interest, or of small molecules with which they interact (e.g., agonists, antagonists, inhibitors), in order to fashion drugs which are, for example, more active or stable forms of the polypeptide, or which, e.g., enhance or interfere with the function of a polypeptide in vivo. See, e.g., Hodgson, 1991. Rational drug design can be performed as described herein or using well-known techniques, such as described in U.S. Pat. Nos. 5,800,998 and 5,891,628, each incorporated herein by reference.

In one approach, one first determines the three-dimensional structure of a protein of interest (e.g., the TBC1D1 polypeptide or fragments of the TBC1D1 polypeptide) or, perhaps, the TBC1D1-receptor or ligand complex, by x-ray crystallography, by computer modeling or most typically, by a combination of approaches. Sometimes useful information regarding the structure of a polypeptide may be gained by modeling based on the structure of homologous proteins. An example of rational drug design is the development of HIV protease inhibitors (Erickson et al., 1990). In addition, peptides (e.g., TBC1D1 polypeptide or fragments thereof) are analyzed by an alanine mutagenesis scan (Wells, 1991). In this technique, a non-alanine amino acid residue is replaced by an alanine residue, and its effect on the peptide's activity is determined. Each of the amino acid residues of the peptide is analyzed in this manner to determine the important regions of the peptide.

It is also possible to isolate a target-specific antibody, selected by a functional assay, and then to solve its crystal structure. In principle, this approach yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. Selected peptides would then act as the pharmacore. Thus, one may design drugs which have, e.g., improved TBC1D1 polypeptide binding activity or stability, or which act as inhibitors, agonists, antagonists, etc. of TBC1D1 polypeptide activity.

Following identification of a substance which modulates or affects TBC1D1 polypeptide activity, the substance may be investigated further. Furthermore, it may be manufactured and/or used in preparation, i.e., manufacture or formulation, or a composition such as a medicament, pharmaceutical composition or drug. These may be administered to individuals alone or in combination with other biologically-active agents.

Thus, the present invention extends in various aspects not only to substances identified as modulators of TBC1D1 activity in accordance with what is disclosed herein, but the present invention also includes pharmaceutical compositions, medicaments, drugs or other compositions comprising such a substance, as well as methods comprising administration of such compositions, and methods comprising administration of such compositions to a patient, e.g., for treatment or prophylaxis of obesity and/or diabetes, or use of such a substance in the manufacture of a composition for administration, e.g., for treatment or prophylaxis of obesity and/or diabetes, and methods of making a pharmaceutical composition comprising admixing such a substance with a pharmaceutically acceptable excipient, vehicle or carrier, and other ingredients as required.

A substance identified as a modulator of TBC1D1 function may be peptide or non-peptide in nature. Non-peptide "small molecules" are often preferred for many in vivo pharmaceutical uses. Accordingly, a mimetic or mimic of the substance (particularly if a peptide) may be designed for pharmaceutical use.

The designing of mimetics to a known pharmaceutically active compound is a known approach to the development of pharmaceuticals based on a "lead" compound. This might be desirable where the active compound is difficult or expensive to synthesize, or where it is unsuitable for a particular method of administration, e.g., pure peptides are unsuitable agents for oral medicaments as they tend to be quickly degraded by proteases in the alimentary canal. Mimetic design, synthesis and testing is generally used to avoid randomly screening large numbers of molecules for a target property.

There are several steps commonly taken in the design of a mimetic from a compound having a given target property. First, the particular parts of the compound that are critical and/or important in determining the target property are determined. In the case of a peptide, this can be done by systematically varying the amino acid residues in the peptide, e.g., by substituting each residue in turn. Alanine scans of peptides are commonly used to refine such peptide motifs. The parts or residues constituting the active region of the compound are known as its "pharmacophore".

Once the pharmacophore has been found, its structure is modeled according to its physical properties, e.g., stereochemistry, bonding, size and/or charge, using data from a range of sources, e.g., spectroscopic techniques, x-ray diffraction data and NMR. Computational analysis, similarity mapping (which models the charge and/or volume of a pharmacophore, rather than the bonding between atoms) and other techniques can be used in this modeling process.

In a variaton of this approach, the three-dimensional structure of the ligand and its binding partner are modeled. This can be especially useful where the ligand and/or binding partner change conformation upon binding, allowing the model to take account of this within the design of the mimetic.

A template molecule is then selected onto which chemical groups that mimic the pharmacophore can be grafted. The template molecule and the chemical groups grafted onto it can conveniently be selected so that the mimetic is easy to synthesize, is likely to be pharmacologically acceptable, and does not degrade in vivo, while retaining the biological activity of the lead compound. Alternatively, where the mimetic is peptide-based, further stability can be achieved by cyclizing the peptide, thereby protecting its ends from cellular exopeptidases. The mimetic or mimetics found by this approach can then be screened to see whether or not they have desired properties, or to determine to what extent they do. Further optimization or modification can then be carried out to arrive at one or more final mimetics for testing in vivo or in clinical trials.

Methods of Use

Nucleic Acid Based Therapies

According to the present invention, a method is also provided of supplying wild-type TBC1D1 function to a cell that carries mutant TBC1D1 alleles. The wild-type TBC1D1 gene or a part of the gene may be introduced into the cell in a vector such that the gene remains extrachromosomal. In such a situation, the gene will be expressed by the cell from the extrachromosomal location. If a gene fragment is introduced and expressed in a cell carrying a mutant TBC1D1 allele, the gene fragment should encode a part of the TBC1D1 protein that is required for the normal physiological processes of the cell. More preferred is the situation where the wild-type TBC1D1 gene, or a part thereof, is introduced into the mutant cell in such a way that it recombines with the endogenous mutant TBC1D1 gene present in the cell. Such recombination requires a double recombination event, which results in the correction of the TBC1D1 gene mutation. Vectors for the introduction of genes, both for recombination and for extrachromosomal maintenance, are known in the art, and any suitable vector may be used. Methods for introducing DNA into cells, such as electroporation, calcium phosphate coprecipitation and viral transduction, are also known in the art, and the choice of method is within the competence of the routineer. See also U.S. Pat. Nos. 5,800,998 and 5,891,628, each of which is incorporated by reference herein.

Among the compounds which may exhibit anti-obesity activity are antisense, ribozyme, siRNA, and triple helix molecules. Such molecules may be designed to reduce or inhibit mutant TBC1D1 activity. Techniques for the production and use of such molecules are well known to those of skill in the art, such as described herein or in U.S. Pat. No. 5,800,998, incorporated herein by reference.

Antisense RNA and DNA molecules act to either directly block the translation of mRNA by binding to targeted mRNA and preventing protein translation or by activating the cleavage of target transcripts by cellular ribonuclease-H(RNase H). With respect to antisense DNA, oligodeoxyribonucleotides directed to the translation initiation site, e.g., between the −10 and +10 regions of the TBC1D1 nucleotide sequence of interest, are preferred.

Ribozymes are enzymatic RNA molecules capable of catalyzing the specific cleavage of RNA. The mechanism of ribozyme action involves sequence specific hybridization of the ribozyme molecule to complementary target RNA, followed by an endonucleolytic cleavage. The composition of ribozyme molecules must include one or more sequences complementary to the target TBC1D1 mRNA, preferably the mutant TBC1D1 mRNA, and must include a well known catalytic sequence responsible for the enzymatic activity behind mRNA cleavage. For an example of such a sequence, see U.S. Pat. No. 5,093,246, which is incorporated by reference herein in its entirety. As such, within the scope of the invention are engineered hammerhead motif ribozyme molecules that specifically and efficiently catalyze the endonucleolytic cleavage of mRNA sequences encoding TBC1D1, and preferably mutant TBC1D1 proteins.

Specific ribozyme cleavage sites within any potential RNA target are initially identified by scanning the target molecule for potential ribozyme cleavage sites which include the following sequences: GUA, GWU and GUC. Once potential cleavage sites have been identified, short RNA sequences of between 15 and 25 ribonucleotides corresponding to the region of the target gene containing the cleavage site may be evaluated for predicted structural features, such as secondary structure, that may render the oligonucleotide sequence unsuitable for targeted cleavage by ribozymes. The suitability of candidate targets may also be evaluated by testing their accessibility to hybridization with complementary oligonucleotides, using ribonuclease protection assays and other techniques known in the art.

Nucleic acid molecules to be used in triplex helix formation should be single stranded and composed of deoxynucleotides. The base composition of these oligonucleotides must be designed to promote triple helix formation via Hoogsteen base pairing rules, which generally require sizeable stretches of either purines or pyrimidines to be present on one strand of a duplex. Nucleotide sequences may be pyrimidine-based, which will result in TAT and CGC$^+$ triplets across the three associated strands of the resulting triple helix. The pyrimidine-rich molecules provide base complementarity to a purine-rich region of a single strand of the duplex in a parallel orientation to that strand. In addition, nucleic acid molecules may be chosen that are purine-rich, for example, contain a stretch of guanidine residues. These molecules will form a triple helix with a DNA duplex that is rich in GC pairs, in which the majority of the purine residues are located on a single strand of the targeted duplex, resulting in GGC triplets across the three strands in the triplex.

Alternatively, the potential sequences that can be targeted for triple helix formation may be increased by creating a so-called "switchback" nucleic acid molecule. Switchback molecules are synthesized in an alternating 5'-3', 3'-5' manner, such that they base pair with one strand of a duplex first and then the other, eliminating the necessity for a sizeable stretch of either purines or pyrimidines to be present on one strand of a duplex.

It is possible that the antisense, ribozyme, and/or triple helix molecules described herein may reduce or inhibit the translation of mRNA produced by both normal and mutant TBC1D1 alleles. In order to ensure that substantial normal levels of TBC1D1 activity are maintained in the cell, nucleic acid molecules that encode and express TBC1D1 polypeptides exhibiting normal TBC1D1 activity may be introduced into cells that do not contain sequences susceptible to whatever antisense, ribozyme, or triple helix treatments are employed. Such sequences may be introduced via gene therapy methods. Alternatively, it may be preferable to coadminister normal TBC1D1 protein into the cell or tissue in order to maintain the requisite level of cellular or tissue TBC1D1 activity.

Antisense RNA and DNA molecules, ribozyme molecules and triple helix molecules of the invention may be prepared by any method known in the art for the synthesis of DNA and RNA molecules. These include techniques for chemically synthesizing oligodeoxyribonucleotides and oligoribonucleotides well known in the art such as, for example, solid phase phosphoramidite chemical synthesis. Alternatively, RNA molecules may be generated by in vitro or in vivo transcription of DNA sequences encoding the antisense RNA molecule. Such DNA sequences may be incorporated into a wide variety of vectors that incorporate suitable RNA polymerase promoters such as the T7 or SP6 polymerase promoters. Alternatively, antisense cDNA constructs that synthesize antisense RNA constitutively or inducibly, depending on the promoter used, can be introduced stably into cell lines.

siRNAs are short intermolecular duplexes, generally composed of two distinct (sense and antisense) strands of RNA, each of approximately 21 nucleotides, that form approximately 19 base-pairs, with single stranded 3' overhangs of 1-3, preferably 2 nucleotides. The base-paired region of siRNAs generally substantially corresponds, preferably exactly, to a "target sequence" and its complement, in an RNA transcript to be targeted for degradation.

The specific features of siRNAs required for inducing the efficient degradation or silencing of corresponding RNA transcripts have been systematically investigated, as have the features of the target sequence within the targeted transcript. The results of such experiments have been published and general guideline have been established for the design of effective siRNA molecules (see: Tuschl et al., Genes & Dev. 13:3191-3197 (1999) and Elbashir et al., EMBO J. 20:6877-6888 (2001), and discussions in "The siRNA User Guide".

Generally, the most effective silencing is obtained with siRNA duplexes composed of 21 nucleotide sense and antisense strands that are paired in a manner to produce 2 nucleotide 3' overhangs. The sequence of the overhangs makes only a small contribution to the overall specificity of target recognition, but the identity of the nucleotide adjacent to the paired region can have an effect. In addition, the 3' overhangs can be composed either ribonucleotides or 2'-deoxyribonucleotides, with no apparent differences in efficacy, however siRNAs with 2'-deoxyribonucleotide overhangs may be more resistant to cellular nucleases.

Target sequences in targeted RNA transcripts preferably have the sequence AA(19N)UU, where N=any nucleotide, but can be any contiguous 19 nucleotides. Importantly, target sequences must be chosen from the sequences present in mature mRNAs, but can reside in either coding or non-coding regions (e.g., 5' and 3' UTRs). Preferably the target sequence chosen is readily "accessible," to the siRNA, that is, not involved in a stable base-paired structure within the mature transcript, and not specifically bound by an RNA-binding protein. RNA folding algorithms, such as the "Sfold" algorithm developed by Ding and Lawrence (described in *Nucleic Acids Res.* 29:1034-1046 (2001)), which is incorporated by reference in its entirety) can be useful for picking target sequences that have a greater likelihood of being accessible, and therefore efficiently targeted by a corresponding siRNA, resulting in degradation of the targeted transcript and reduction in the cellular concentration of its encoded gene product.

One example of an siRNA for use in reducing TBC1D2 expression is an siRNA having the following structure:

```
5'-    AGUAUUUGUCCCGGGGUAdTdT-3'    (SEQ ID NO:107)
       ||||||||||||||||||||
3'-dTdTUCAUAAAACAGGGCCCCAU      -5'  (SEQ ID NO:108)
``` siRNAs can optionally be produced within cells from precursors such as small hairpin RNAs (shRNAs), by the action of cellular RNases. Importantly, such shRNAs can be transcribed from expression cassettes introduced into cells, allowing for the stable silencing of targeted genes. Details of the intracellular expression of such shRNAs can be found in U.S. Patent Application No. 2003/0148519, which is incorporated herein in its entirety.

Various well-known modifications to nucleic acid molecules may be introduced as a means of increasing intracellular stability and half-life. Possible modifications include, but are not limited to, the use of phosphorothioate or 2' O-methyl rather than phosphodiesterase linkages within the oligodeoxyribonucleotide backbone.

Gene therapy would be carried out according to generally accepted methods. For example, as described in further detail in U.S. Pat. Nos. 5,837,492 and 5,800,998, and the references cited therein, all of which are incorporated by reference herein. Expression vectors in the context of gene therapy are meant to include those constructs containing sequences sufficient to express a polynucleotide that has been cloned therein. In viral expression vectors, the construct contains viral sequences sufficient to support packaging of the construct. If the polynucleotide encodes an antisense polynucleotide, shRNA, or a ribozyme, expression will produce the antisense polynucleotide, shRNA, or ribozyme. Thus in this context, expression does not require that a protein product be synthesized. In addition to the polynucleotide cloned into the expression vector, the vector also contains a promoter that is functional in eukaryotic cells. The cloned polynucleotide sequence is under control of this promoter. Suitable eukaryotic promoters include those described above. The expression vector may also include sequences, such as selectable markers and other sequences conventionally used.

Methods of Use

Peptide Therapy

Peptides that have TBC1D1 activity can be supplied to cells that carry mutant or missing TBC1D1 alleles. Peptide therapy is performed as described herein or using well-known techniques, such as described in U.S. Pat. Nos. 5,800,998 and 5,891,628, each of which is incorporated herein by reference.

Protein can be produced by expression of a cDNA template sequence in bacteria, for example, using known expression vectors. Alternatively, TBC1D1 polypeptide can be extracted from TBC1D1-producing mammalian cells. In addition, the techniques of synthetic chemistry can be employed to synthesize TBC1D1 polypeptides. Any of such techniques can provide the preparation of the present invention that comprises the TBC1D1 protein, or some fragment thereof. Such preparations must be substantially free of other human proteins. This is most readily accomplished by recombinant synthesis within a microorganism or in vitro.

Active TBC1D1 molecules can be introduced into cells, either by microinjection, or by use of liposomes, for example. Alternatively, active TBC1D1 molecules may be taken up by cells, either actively, or by diffusion. Extracellular application of the TBC1D1 gene product may be sufficient to affect the development and or progression of obesity. Supplying cells with polypeptides with TBC1D1 activity should lead to partial reversal of the obesity and/or diabetic phenotype. Other molecules with TBC1D1 activity (for example, peptides, drugs or organic compounds) may also be used to effect such a reversal. Modified polypeptides having substantially similar function are also used for peptide therapy.

Alternatively, antibodies that are both specific for mutant TBC1D1 gene product and interfere with its activity may be used. Such antibodies may be generated using standard techniques described herein or using conventional techniques, such as described in U.S. Pat. Nos. 5,837,492; 5,800,998 and 5,891,628, against TBC1D1 itself or against peptides corresponding to the binding domains of TBC1D1. Such antibodies include but are not limited to polyclonal, monoclonal, Fab fragments, F(ab')$_2$ fragments, single chain antibodies, chimeric antibodies, humanized antibodies etc.

Methods of Use

Transformed Hosts; Transgenic/Knockout Animals and Models

Cells and animals that carry a mutant TBC1D1 allele can be used as model systems in which to study and test substances that have potential as therapeutic agents. The mutant alleles may be isolated from individuals with TBC1D1 mutations, either somatic or germline, and the DNA bearing the mutation can be introduced into the cells or animals. Alternatively, a cell line can be engineered to carry one of the mutations in the TBC1D1 allele described above, using various molecular biological techniques. After a test substance is applied to the transgenic cells, the phenotype of the cell is determined. Any trait of the transformed cells can be assessed using techniques well known in the art. Transformed hosts, such as transgenic/knockout animals and models are prepared and used as described herein or using well-known techniques, such as described in U.S. Pat. Nos. 5,800,998 and 5,891,628, each of which is incorporated herein by reference. For example, mutations resulting in R125W, V228G, L392V or equivalent thereof can be incorporated into human TBC1D1 transgenes, or to the orthologous gene of the host.

In preferred embodiments, cell lines or transgenic animals (mice, etc.) are provided having homologous mutations in the orthologous TBC1D1 gene, which result in R125W, V228G, and/or L392V, or the equivalents thereof.

Animals for testing therapeutic agents can be selected after mutagenesis of whole animals or after treatment of germline cells or zygotes. Such treatments include insertion of mutant TBC1D1 alleles, usually from a second animal species, as well as insertion of disrupted homologous genes. Alternatively, the endogenous, orthologous TBC1D1 gene(s) of the animals may be disrupted by insertion or deletion mutation or other genetic alterations using conventional techniques (Capecchi, 1989; Valancius and Smithies, 1991; Hasty et al., 1991; Shinkai et al., 1992; Mombaerts et al., 1992; Philpott et al., 1992; Snouwaert et al., 1992; Donehower et al., 1992) to produce knockout or transplacement animals. A transplacement is similar to a knockout because the endogenous gene is replaced, but in the case of a transplacement the replacement is by another version of the same gene. After test substances have been administered to the animals, the diabetic and/or obesity phenotype is assessed. If the test substance prevents or suppresses the diabetic and/or obesity phenotype, then the test substance is a candidate therapeutic agent for the treatment of obesity. These animal models provide an extremely important testing vehicle for potential therapeutic products and medicaments.

In one embodiment of the invention, transgenic animals are produced which contain a functional transgene encoding a functional TBC1D1 polypeptide or variants thereof. Transgenic animals expressing TBC1D1 transgenes, recombinant cell lines derived from such animals and transgenic embryos may be useful in methods for screening for and identifying agents that induce or repress function of TBC1D1. Transgenic animals of the present invention can also be used as models for studying indications such as obesity and/or diabetes.

In one embodiment of the invention, a TBC1D1 transgene is introduced into a non-human host to produce a transgenic animal expressing a human, murine or other species TBC1D1 gene. The transgenic animal is produced by the integration of the transgene into the genome in a manner that permits the stable expression of the transgene. Methods for producing transgenic animals are generally described by Wagner and Hoppe (U.S. Pat. No. 4,873,191; which is incorporated herein by reference), Brinster et al. 1985; which is incorporated herein by reference in its entirety) and in "Manipulating the Mouse Embryo; A Laboratory Manual" 2nd edition (eds., Hogan, Beddington, Costantimi and Long, Cold Spring Harbor Laboratory Press, 1994; which is incorporated herein by reference in its entirety).

It may be desirable to replace the endogenous TBC1D1 by homologous recombination between the transgene or a mutant gene and the endogenous gene; or the endogenous gene may be eliminated by deletion as in the preparation of "knock-out" animals. Typically, a TBC1D1 gene flanked by genomic sequences is transferred by microinjection into a fertilized egg. The microinjected eggs are implanted into a host female, and the progeny are screened for the expression of the transgene. Transgenic animals may be produced from the fertilized eggs from a number of animals including, but not limited to reptiles, amphibians, birds, mammals, and fish. Within a particularly preferred embodiment, transgenic mice are generated which overexpress wild type TBC1D1 or express a mutant form of the polypeptide, e.g., the equivalent of R125W, V228G, L392V mutant described above (note both R125 and L392 are conserved in the mouse TBC1D1 gene). Alternatively, the absence of a TBC1D1 in "knock-out" mice permits the study of the effects that loss of TBC1D1 protein has on a cell in vivo. Knockout mice also provide a model for the development of TBC1D1-related obesity and/or diabetes.

Methods for producing knockout animals are generally described by Shastry (1995, 1998) and Osterrieder and Wolf (1998). The production of conditional knockout animals, in which the gene is active until knocked out at the desired time is generally described by Feil et al. (1996), Gagneten et al. (1997) and Lobe and Nagy (1998). Each of these references is incorporated herein by reference.

As noted above, transgenic animals and cell lines derived from such animals may find use in certain testing experiments. In this regard, transgenic animals and cell lines capable of expressing wild type or mutant TBC1D1 may be exposed to test substances. These test substances can be screened for the ability to alter expression of wild-type TBC1D1, or alter the expression or function of mutant TBC1D1.

Pharmaceutical Compositions and Routes of Administration

The TBC1D1 polypeptides, antibodies, peptides and nucleic acids of the present invention can be formulated in pharmaceutical compositions, which are prepared according to conventional pharmaceutical compounding techniques. See, for example, *Remington's Pharmaceutical Sciences*, 18th Ed. (1990, Mack Publishing Co., Easton, Pa.). The composition may contain the active agent or pharmaceutically acceptable salts of the active agent. These compositions may comprise, in addition to one of the active substances, a pharmaceutically acceptable excipient, carrier, buffer, stabilizer or other materials well known in the art. Such materials should be non-toxic and should not interfere with the efficacy of the active ingredient. The carrier may take a wide variety of forms depending on the form of preparation desired for a particular route of administration, e.g., intravenous, oral, intrathecal, epineural or parenteral.

For oral administration, the compounds can be formulated into solid or liquid preparations such as capsules, pills, tablets, lozenges, melts, powders, suspensions or emulsions. In preparing the compositions in oral dosage form, any of the usual pharmaceutical media may be employed, such as, for example, water, glycols, oils, alcohols, flavoring agents, preservatives, coloring agents, suspending agents, and the like in the case of oral liquid preparations (such as, for example, suspensions, elixirs and solutions); or carriers such as starches, sugars, diluents, granulating agents, lubricants, binders, disintegrating agents and the like in the case of oral solid preparations (such as, for example, powders, capsules and tablets). Because of their ease in administration, tablets and capsules represent the most advantageous oral dosage unit form, in which case solid pharmaceutical carriers are obviously employed. If desired, tablets may be sugar-coated or enteric-coated by standard techniques. The active agent can be encapsulated to make it stable to passage through the gastrointestinal tract while at the same time allowing for passage across the blood brain barrier. See, for example, PCT Application Publication WO 96/11698.

For parenteral administration, the compound may be dissolved in a pharmaceutical carrier and administered as either a solution or a suspension. Illustrative of suitable carriers are water, saline, dextrose solutions, fructose solutions, ethanol, or oils of animal, vegetative or synthetic origin. The carrier may also contain other ingredients, for example, preservatives, suspending agents, solubilizing agents, buffers and the like. When the compounds are being administered intrathecally, they may also be dissolved in cerebrospinal fluid.

The active agent is preferably administered in a therapeutically effective amount. The actual amount administered, and the rate and time-course of administration, will depend on the nature and severity of the condition being treated. Prescription of treatment, e.g. decisions on dosage, timing, etc., is within the responsibility of general practitioners or specialists, and typically takes account of the disorder to be treated, the condition of the individual patient, the site of delivery, the method of administration and other factors known to practitioners. Examples of techniques and protocols can be found in *Remington's Pharmaceutical Sciences*.

Alternatively, targeting therapies may be used to deliver the active agent more specifically to certain types of cells, by the use of targeting systems such as antibodies or cell specific ligands. Targeting may be desirable for a variety of reasons, e.g. if the agent is unacceptably toxic, or if it would otherwise require too high a dosage, or if it would not otherwise be able to enter the target cells.

Instead of administering these agents directly, they could be produced in the target cell, e.g. from a viral vector such as described above or in a cell based delivery system such as described in U.S. Pat. No. 5,550,050 and published PCT application Nos. WO 92/19195, WO 94/25503, WO 95/01203, WO 95/05452, WO 96/02286, WO 96/02646, WO 96/40871, WO 96/40959 and WO 97/12635, designed for implantation in a patient. The vector could be targeted to the specific cells to be treated, or it could contain regulatory elements which are tissue or target cell specific. The cell based delivery system is designed to be implanted in a patient's body at the desired target site and contains a coding sequence for the active agent. Alternatively, the agent could be administered in a precursor form for conversion to the active form by an activating agent produced in, or targeted to, the cells to be treated. See for example, EP 425,731A and WO 90/07936.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982; Sambrook et al., 1989; Ausubel et al., 1992; Glover, 1985; Anand, 1992; Guthrie and Fink, 1991; Harlow and Lane, 1988; Jakoby and Pastan, 1979; *Nucleic Acid Hybridization* (B. D. Hames & S. J. Higgins eds. 1984); *Transcription And Translation* (B. D. Hames & S. J. Higgins eds. 1984); *Culture Of Animal Cells* (R. I. Freshney, Alan R. Liss, Inc., 1987); *Immobilized Cells And Enzymes* (IRL Press, 1986); B. Perbal, *A Practical Guide To Molecular Cloning* (1984); the treatise, *Methods In Enzymology* (Academic Press, Inc., N.Y.); *Gene Transfer Vectors For Mammalian Cells* (J. H. Miller and M. P. Calos eds., 1987, Cold Spring Harbor Laboratory); *Methods In Enzymology*, Vols. 154 and 155 (Wu et al. eds.), *Immunochemical Methods In Cell And Molecular Biology* (Mayer and Walker, eds., Academic Press, London, 1987); *Handbook Of Experimental Immunology*, Volumes I-IV (D. M. Weir and C. C. Blackwell, eds., 1986); Hogan et al., *Manipulating the Mouse Embryo*, (Cold Spring Harbor Laboratory Press, Cold Spring Harbor, N.Y., 1986). A general discussion of techniques and materials for human gene mapping, including mapping of human chromosome 1, is provided in White and Lalouel (1988).

EXAMPLES

The present invention is described by reference to the following Example, which is offered by way of illustration and is not intended to limit the invention in any manner. Standard techniques well known in the art or the techniques specifically described below were utilized.

Example 1

Association of TBC1D1 and Obesity

We have conducted a genome wide search with 628 markers using multigenerational Utah pedigrees to identify genes involved in obesity predisposition. Models used in this analysis were females-only and affecteds-only with dominant, codominant and recessive modes of inheritance. The resource used to define this linkage was 37 Utah pedigrees with 994 individuals.

From the genome search, we identified a highly significant linkage to high BMI at D4S2632 with a multipoint HLOD score of 6.1 (p-value $10^{-7}$) and a nonparametric linkage score of 5.3 (p-value $10^{-6}$). To pursue the 4p14-15 linkage, we increased both the marker density around D4S2632 and the size of our pedigree data set. As a result, the linkage evidence increased to a HLOD score of 9.2 (at D4S3350, p-value $10^{-10}$) and a nonparametric linkage score of 11.3 (p-value $10^{-12}$). The fraction of families that support the linkage ($\alpha$) is 0.46. The region defined by the linkage evidence is 10 cM or about 10 million bases and contains approximately 20 genes.

From fifteen families with good evidence for linkage to this region, two pedigree members that shared the segregating haplotype were mutation screened. Variants that change the encoded amino acid (missense changes), were scrutinized for evidence that the variant changes the function of the gene and that the change results in a higher risk of obesity. A gene carrying such variants would be a good candidate for the obesity susceptibility gene. Causal variants will segregate into other affected individuals in the family and will be more rare than in non-cases than in cases.

The TBC1D1 consensus cDNA sequence is 3791 nucleotides and is covered by three human genomic DNA sequences (GenBank accessions AC021106, AC009595, and AC044902). It has a 1168-amino acid open reading frame with an initiating methionine codon (ATG) at nucleotides 1-3 and a 3' STOP codon (TAG) at nucleotides 3505-3507. The amino acid sequence has an 95% identity to the mouse Tbc1 protein (GenBank accession number T29104). Both the initiation codon and the 3' STOP codon are conserved.

The TBC1D1 cDNA sequence was constructed using the mouse tbc1 mRNA sequence (GenBank accession U33005), as a template and assembling human sequence available in the public databases. The majority of the TBC1D1 cDNA sequence, nucleotide positions 1216 to 3791, is derived from a partial coding sequence, KIAA1108 (GenBank accession AB029031). A series of three overlapping ESTs (GenBank accession numbers AI872406, AW204569, and BE279997) were assembled to generate the 5' end of TBC1D1, nucleotide positions 1-1491.

TBC1D1 is the founding member of a family of related proteins with homology to tre-2/UPS6, BUB2, and cdc16 and containing the TBC box motif at amino acids 180-220. In mice, Tbc1 showed differential expression in two mast cell lines. It was localized in the nucleus, and was expressed at the highest levels in hematopoietic cells, testis and kidney. Within these tissues, expression of Tbc1 was cell- and stage-specific. Based on sequence similarity, pattern of expression and subcellular localization, Tbc1 may play a role in the cell cycle and in the differentiation of various tissues.

Two missense changes (see Table 1) were detected. Arg→Trp (R125W) in families 436, 7082, 7380, 7228, 7256.1, 11063, 7158.2 and 1220. This variant was enriched in our linked-cases (p value $10^{-4}$) as compared to random controls, and segregated with obesity in 6 families. R125 is conserved in mice and is in the phosphotyrosine interacting domain (PID). We have also detected a gene haplotype containing both Val→Gly and Leu→Val, which segregates with the disease in families 736201, 7444, 7390, and 740701. This haplotype is also enriched in linked cases as compared to random controls. Individually, the variants are enriched in linked-cases with p-values of 0.02 and 0.01 respectively.

TABLE 1

Alterations in TBC1D1 Associated with Obesity

| Kindred | Variant | Nucleotide Change | Amino Acid Change | Observations in control chromosomes | p-value for Linked-cases vs. Controls |
|---------|---------|-------------------|-------------------|--------------------------------------|----------------------------------------|
| 436 | Arg → Trp | C373T | R125W | 22/334 | 0.0001 |
| 7082 | Arg → Trp | C373T | R125W | | |
| 7380 | Arg → Trp | C373T | R125W | | |
| 7228 | Arg → Trp | C373T | R125W | | |
| 7256.1 | Arg → Trp | C373T | R125W | | |
| 11063 | Arg → Trp | C373T | R125W | | |
| 7158.2 | Arg → Trp | C373T | R125W | | |
| 1220 | Arg → Trp | C373T | R125W | | |

TABLE 1-continued

Alterations in TBC1D1 Associated with Obesity

| Kindred | Variant | Nucleotide Change | Amino Acid Change | Observations in control chromosomes | p-value for Linked-cases vs. Controls |
|---|---|---|---|---|---|
| 736201 | Val → Gly; Leu → Val | T683G; C1174G | V228G; L392V | 119/340; 40/350 | 0.02; 0.01 |
| 7444 | Val → Gly; Leu → Val | T683G; C1174G | V228G; L392V | | |
| 7390 | Val → Gly; Leu → Val | T683G; C1174G | V228G; L392V | | |
| 74701 | Val → Gly; Leu → Val | T683G; C1174G | V228G; L392V | | |

Shaded boxes: variant segregates with obesity in indicated family

Example 2

Cell and Animal Obesity Disease Models

Compounds identified by the drug screens of the invention (i.e., those that modify TCB1D1 bioactivity) can be further tested in obesity disease models. Preferably, any compound or molecule identified as being capable of affecting the bioactivity of TCB1D1 in a primary screen is tested in an animal or cell-based obesity disease model. Compounds that show activity in the secondary screen (i.e., obesity disease model) are identified as having obesity disease modifying activity.

The skilled artisan is capable of testing compounds that affect TCB1D1 bioactivity in obesity disease models. Any obesity disease model can be used. Preferably, drug candidates that have obesity disease modifying activity, show an effect in several different obesity disease models. It is preferred that the drug candidates that have obesity disease modifying activity show a disease modifying affect in at least 2, 3, 4, or more obesity disease models.

A variety of obesity disease models are known to the skilled artisan. A preferred disease models is a transgenic animal, preferably a mouse or rat that has an altered TCB1D1 gene variant associated with obesity. The animal can be heterozygous or homozygous for said TCB1D1 variant. Preferably the animal displays an observable phenotype (e.g., is obese) that is detectably different from the wild-type phenotype. Drug candidates identified as affecting TCB1D1 bioactivity in the primary screen are then tested in a group of transgenic animals. A drug candidate having obesity disease modifying activity decreases obesity associated with the transgenic animal having the TCB1D1 variants as compared to a group of control transgenic animal that are not treated with the drug candidate. Similarly other disease models can be used such as obese mice, obese rats, and transgenic animals that have an obese phenotype. See, e.g., Chagnon et al. *Obesity Res.* 11:313-267 (2003); Tran et al. *Surg.* 134:372-377 (2003); Farley et al. *Obesity Res.* 11:845-851 (2003); Dobrian et al. *Am J. Physiol. Renal Physiol.* (Jun. 10 2003 Epub); Kero et al. *Am. J. Physiol. Endo. Metab.* (May 28, 2003 Epub); Serra et al. *J. Cell. Physiol.* 196:89-97 (2003); Bailhache et al. *Metabolism* 52:559-564 (2003); Masaki et al. *Endocrinology* 144:2741-2748 (2003); Uehara et al. *Int. J. Mol. Med.* 11:723-727 (2003); Woods et al. *J. Nutr.* 133:1081-1087 (2003); Miyasaka et al. *Mech. Ageing Dev.* 124:183-190 (2003); and Comuzzie et al. *Obesity Res.* 11:75-80 (2003).

While the invention has been disclosed in this patent application by reference to the details of preferred embodiments of the invention, it is to be understood that the disclosure is intended in an illustrative rather than in a limiting sense, as it is contemplated that modifications will readily occur to those skilled in the art, within the spirit of the invention and the scope of the appended claims.

BIBLIOGRAPHY

Altschul, S. F. et al. (1990). Basic local alignment search tool. *J. Mol. Biol.* 215:403-410.

Altschul, S. F. et al. (1997). Gapped BLAST and PSI-BLAST: a new generation of protein database search programs. *Nucl. Acids Res.* 25:3389-3402.

Anand, R. (1992). *Techniques for the Analysis of Complex Genomes*, (Academic Press).

Ausubel, F. M., et al. (1992). *Current Protocols in Molecular Biology*, (J. Wiley and Sons, NY).

Bartel, P. L., et al. (1993). "Using the 2-hybrid system to detect protein-protein interactions." In: *Cellular Interactions in Development: A Practical Approach*, Oxford University Press, pp. 153-179.

Borman S (1996). *Chemical & Engineering News*, December 9 issue, pp. 42-43.

Botstein, et al. (1980). *Am. J. Hum. Genet.* 32:314-331.

Capecchi, M. R. (1989). *Science* 244:1288.

Cariello (1988). *Human Genetics* 42:726.

Chee M, et al. (1996). *Science* 274:610-614.

Chevray, P. M. and Nathans, D. N. (1992). *Proc. Natl. Acad. Sci. USA* 89:5789-5793.

Conner, B. J., et al. (1983). *Proc. Natl. Acad. Sci. USA* 80:278-282.

Cotton, et al. (1988). *Proc. Natl. Acad. Sci. USA* 85:4397-4401.

DeRisi J, et al. (1996). *Nat. Genet.* 14:457-460.

Donehower, L. A., et al. (1992). *Nature* 356:215.

Erickson, J. et al., (1990). *Science* 249:527-533.

Feil et al., (1996). *Proc. Natl. Acad. Sci. USA* 93:10887-10890.

Fields, S, and Song, O-K. (1989). *Nature* 340:245-246.

Finkelstein, J., et al. (1990). *Genomics* 7:167-172.

Fodor, S. P. A. (1997). DNA Sequencing. Massively Parallel Genomics. *Science* 277:393-395.

Gagneten et al. (1997). *Nucl. Acids Res.* 25:3326-3331.

Glover, D. (1985). *DNA Cloning, I and II* (Oxford Press).

Grompe, M., (1993). *Nature Genetics* 5:111-117.

Grompe, M., et al., (1989). *Proc. Natl. Acad. Sci. USA* 86:5855-5892.

Guthrie, G. and Fink, G. R. (1991). *Guide to Yeast Genetics and Molecular Biology* (Academic Press).

Hacia J G, et al. (1996). *Nature Genetics* 14:441-447.

Harlow and Lane (1988). *Antibodies: A Laboratory Manual* (Cold Spring Harbor Laboratory, Cold Spring Harbor, N.Y.

Hasty, P., K., et al. (1991). *Nature* 350:243.

Hodgson, J. (1991). *Bio/Technology* 9:19-21.

Hogan et al. (eds) (1994). *Manipulating the Mouse Embryo: A Laboratory Manual*, 2$^{nd}$ Edition, Cold Spring Harbor Laboratory Press, Cold Spring Harbor, N.Y.

Jablonski, E., et al. (1986). *Nuc. Acids Res.* 14:6115-6128.

Jakoby, W. B. and Pastan, I. H. (eds.) (1979). *Cell Culture. Methods in Enzymology*, Vol. 58 (Academic Press, Inc., Harcourt Brace Jovanovich (NY).

Jeffreys, et al. (1985). *Nature* 314:67-73.

Kinszler, K. W., et al. (1991). *Science* 251:1366-1370.

Kinzler, K. W. and Vogelstein, B. 1997. *Nature* 386: 761-763.
Landegren, et al. (1988). *Science* 242:229.
Lee, J. E., et al. (1995). *Science* 268:836-844.
Lipshutz R J, et al. (1995). *BioTechniques* 19:442-447.
Litt, et al. (1989). *Am. J. Hum. Genet.* 44:397-401.
Lobe and Nagy (1998). *Bioessays* 20:200-208.
Lockhart D J, et al. (1996). *Nature Biotechnology* 14:1675-1680.
Maniatis. T., et al. (1982). *Molecular Cloning: A Laboratory Manual* (Cold Spring Harbor Laboratory, Cold Spring Harbor, N.Y.).
Matthews and Kricka (1988). *Anal. Biochem.* 169:1.
Mittlin (1989). *Clinical Chem.* 35:1819.
Modrich, P. (1991). *Ann. Rev. Genet.* 25:229-253.
Mombaerts, P., et al. (1992). *Cell* 68:869.
Nakamura, et al. (1987). *Science* 235:1616-1622.
Newton, C. R., et al. (1989). *Nucl. Acids Res.* 17:2503-2516.
Nguyen, Q., et al. (1992). *BioTechniques* 13:116-123.
Novack, et al. (1986). *Proc. Natl. Acad. Sci. USA* 83:586.
Orita, et al. (1989). *Proc. Natl. Acad. Sci. USA* 86:2776-2770.
Osterrieder and Wolf (1998). *Rev. Sci. Tech.* 17:351-364.
Perusse, L. et al. (2001). *Obes Res* 9:135-69.
Philpott, K. L., et al. (1992). *Science* 256:1448.
Rano and Kidd (1989). *Nucl. Acids Res.* 17:8392.
Rigby, P. W. J., et al. (1977). *J. Mol. Biol.* 113:237-251.
Sambrook, J., et al. (1989). *Molecular Cloning: A Laboratory Manual,* 2nd Ed. (Cold Spring Harbor Laboratory, Cold Spring Harbor, N.Y.).
Shastry et al. (1995). *Experientia* 51:1028-1039.
et al. (1998). *Mol. Cell. Biochem.* 181:163-179.
Sheffield, V. C., et al. (1989). *Proc. Natl. Acad. Sci. USA* 86:232-236.
Sheffield, V. C., et al. (1991). *Am. J. Hum. Genet.* 49:699-706.
Shenk, et al. (1975). *Proc. Natl. Acad. Sci. USA* 72:989.
Shinkai, Y., et al. (1992). *Cell* 68:855.
Shoemaker D D, et al. (1996). *Nature Genetics* 14:450-456.
Skolnick, M. H. and Wallace, B. R. (1988). *Genomics* 2:273-279.
Snouwaert, J. N., et al. (1992). *Science* 257:1083.
Tavtigian, S., et al. (1996). *Nature Genetics* 12:333-337.
Wartell, R. M., et al. (1990). *Nucl. Acids Res.* 18:2699-2705.
Weber and May (1989). *Am. J. Hum. Genet.* 44:388-396.
Wells, J. A. (1991). *Methods in Enzymol.* 202:390-411.
Wetmur, J. G. and Davidson, N. (1968). "Kinetics of renaturation of DNA." *J. Mol. Biol.* 31:349-370.
White, M. B., et al., (1992). *Genomics* 12:301-306.
Lalouel (1988). *Ann. Rev. Genet.* 22:259-279.
U.S. Pat. No. 4,376,110.
U.S. Pat. No. 4,486,530.
U.S. Pat. No. 4,868,105.
U.S. Pat. No. 4,873,191.
U.S. Pat. No. 5,093,246.
U.S. Pat. No. 5,550,050.
U.S. Pat. No. 5,800,998.
U.S. Pat. No. 5,837,492.
U.S. Pat. No. 5,891,628.
European Patent Application Publication No. 225,807
European Patent Application Publication No. 425,731A.
European Patent Application Publication No. 0332435
Geysen, H., PCT published application No. WO 84/03564, published 13 Sep. 1984
PCT published application No. WO 90/07936.
PCT published application No. WO 92/19195.
PCT published application No. WO 93/07282
PCT published application No. WO 94/25503.
PCT published application No. WO 95/01203.
PCT published application No. WO 95/05452.
PCT published application No. WO 96/02286.
PCT published application No. WO 96/02646.
PCT published application No. WO 96/11698.
PCT published application No. WO 96/40871.
PCT published application No. WO 96/40959.
PCT published application No. WO 97/12635.

---

SEQUENCE LISTING (108 sequences)

SEQ ID NO: 1 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 2 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 3 - DNA, 1215 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatg

SEQ ID NO: 4 - protein, 405 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGM

SEQ ID NO: 5 - DNA, 18 bp, Homo sapiens
ttctgcggccgcgtgacg

SEQ ID NO: 6 - DNA, 25 bp, Homo sapiens
ctcttctgcggccgcgtgacggtgg

SEQ ID NO: 7 - DNA, 822 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcatt

SEQ ID NO: 8 - protein, 274 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLI

SEQ ID NO: 9 - DNA, 681 bp, Homo sapiens
ggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatg

SEQ ID NO: 10 - protein, 227 aa, Homo sapiens
GRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGM

SEQ ID NO: 11 - DNA, 4133 bp, Homo sapiens
gctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 12 - DNA, 4011 bp, Homo sapiens
acttccctcctagagcaatggcacctgcaggtaagagctgagtggtgagctcttacttctgcactctgcactgggccagtatggatctccccaaccacatttgacagtcttcatcctgccataccaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 13 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgatgggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 14 - protein, 1170 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTMGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQIMEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 15 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccactggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 16 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHWQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 17 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgggcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 18 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPGRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 19 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccgtgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 20 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPVQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 21 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgggcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccgtgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 22 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPGRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPVQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 23 - DNA, 21 bp, Homo sapiens
gacgccgtccactggcagagt

SEQ ID NO: 24 - DNA, 21 bp, Homo sapiens
gccaggagcctgggcgcaggc

SEQ ID NO: 25 - DNA, 21 bp, Homo sapiens
tgagggctgccccgtgcaaag

SEQ ID NO: 26 - DNA, 3900 bp, Homo sapiens
atgacttcattaaattctaatgcctctggttttctcccccaggtttctgcatatgaagtgtgtaaaatagattgcttgatccaaaacagaaaaacagtgataactgttttgctgagttcccagacccttcccaagatggaaccaataacattcacagcaaggaaacatctgcttyctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgccgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgatgggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatkgcagcagagaatatyggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtgg

SEQ ID NO: 27 - protein, 1295 aa, Homo sapiens
  misc_feature (59)..(59): Xaa can be any naturally occurring amino acid
  misc_feature (520)..(520): Xaa can be any naturally occurring amino acid
  misc_feature (525)..(525): Xaa can be any naturally occurring amino acid
MTSLNSNASGFLPQVSAYEVCKIDCLIQNRKTVITVLLSSQTLPKMEPITFTARKHLLXNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTMGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQXAAENXGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGDQLCRRDCNTIPHCPGLNEGQKTLEGEKEAGSVLLREETGLPASRFLRTPTCNSGGMSQCFFCCFILNRPFSSPDYCTQLMAW

SEQ ID NO: 28 - DNA, 249881 bp, Homo sapiens
ctctgttgccatcaccaaggccccattggcccacgcttctaccatggtgtgtaccagctctcctgggagtcacgtggccacatatcaaggggaaggagctacttccctcctagagcaatggcacctgcaggtaagagctgagtggtgagctcttacttctgcactctgcactgggccagtatggatctccccaaccacatttgacagtcttcatcctgccataccaggtatcaccatctgcttcaaagtcccctttactatttgttctacaactgctagaaaacctaaggccaaatagattgatagcaagctgtcccctaatttctaagataatgctgtatagattttaaaaagaatttcaacaatccttattgcatactatagagggagttctgtttcccagaagttgaaagtatggtaaaatccctcctcatcattcttagggtgctagctgtcctgggagctggaaaagtgatgcagaaattgctgcttctcacaaggccatgacctctccctaacctaggtaagggtcaaggcaaatggtcatttgccactaaattataaatctctgagctggaacttgctggatgtcaatgctttgagagatatgaggcctgggcctgcatctgggccccacccatcgacttcctacatctgtattctggttaggcaccccgcctggctgcctacctgtacttaagccttcctgtactctgggactaggggtaagggtgaagagagggtagaggaggtgagcaagtgagggaaagaaaaggtagtggagtggcaggatgggagggggctctagccaggatgttctgtaagcagagcccagcaaattatctctgttccccttggcctgaccccttttcccaggagcagggcctggcaagcagggttgttaggtaacagtttcaaccatcctctggtgggttacatacaaaaagcagtttacagtgtcaatgaaatgaatgctagtgtacctttctcgacctcctagcactctggaggtaaatgtgtgcagcaggtcactgcagacagggagagagagttctacaacagagttgaaggtaaaaacatgaaataatttgggatatgacccaagtgataacaatatggtttaactggtttacctggtcttgtaacctaaagaataatttccataacccagttaacattctactcattacagtatttatgactgtatatttcttaaaaaagagttgaggctatgcacacaaataactactcaatgacaaagaatgagctgagggctacacagtggccagagagcaagtatattataaagggctttggatcttggagattccagcacccactaaccctgtaggcactaacctcttacttttctccttagtcaaatggatttaacaatctttgccctgcagagtttttgagcaaattagcaacaatatataaggacagtatctagcacaataccccaaatcgactaactcctccgtaaagaatagctaccactattgtgagagttttaagtcaagctgtgaataaaactcttgggtccacttaaaaatacctcccctggatgtaagcatccagggaaatcagggaatgccataagacagccctaatctaaaagcctacaagaagctcagtgggcttcaaggaagacactgctcttggtacgatgaggaaacctggccctctatttgcctcctgggccacagtaatattgataatagctgctgcttttagttgaggaccatgtacgtctgtgtcactgcactggccactttacttacactttcctgctttgtcctcacaaagatcctgtaaggtgtgtattggtcccatttagcaggtaagacaatgaagaccagaggtccagcaccttgcctaaaccacacctgctgggatttggattcaagtccaaccgtacagctcaaacgctcagccacttccctaaagtccacccccagctacattaagtaaaaaaatccagaaagatgccacctgggggtctggaactgcctcctccgagcacccggctctcccctccctgcggactcttctctggagaggatgtgatgcttcttacttttctcagatccctctccccaccctgcgagtgacgttgcgcctctgtgcctggtgggatagggatctgggagcttcgcctgttttttgcacactgccatcccctagtcttagggagcgagctctgtcccgcttttcacatctccgcgtctttccttgcactctacatcaccgctgggaatgtccccagacctgatcggggcatgcacactggggtgtgcgtgtgcgtgtggtgtgtgttcctgcgcgtgtgccgggctcgcggggcaggaaaaagcgcctaatccaggctctgcgtcactcccgcaattggttagaaatggagtttcctggtgtttaatcccgggagggcacttcgccttcgttgtttcccagagtccctgattttcctgcctcgcatgccagcgccccatagggcatccgtgcctcagttcacctcttgccatcctccaaggacggggagaaggggtaaggcgggggagagcaaggtggcttggtcgcccccggcccccgccccccatgttgtgtgcagtttccaccacgtctgtttcggagggagaagaggagggtgcagatgaggcgaggcgccttcgggagcgcggagagcgggcaggcagtgccacctgctgagagccactcaggccgagcaagcggcgggcagtgccacctgctataaataggccgccaaggacagggtgtgcgactgtacatcccgccacgagggcctgcatcacgcgcggggccccgcgcccccggctccccagggaaacgctgtgcccagatcctgcgcaggggtctggatggggcggcggcccgagtacttcccccctattccccccacagacactggctgaggatggcccgcgggcttgggggcggggggtggcaaggaggggagggaggccgcggcggacccgcagtgcagcagctgttgctcgcgtgtgactcgcccgtccgggccgtgctgcccaggcacagtcacacggcgcagtggggaggaggaggacaccgagtccccctcccagctccccggggaccgagtggggagatcccggctcctgtcttcccctcgcctccagcgcgctcgcccaggctgggaggaggaaaccagagccgcgcgcagacacctcctccttctcctcctcttcttcctcctcctcctcctcctcctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtaaggcgcttcctggggcttcgtcctggccaccctgctggctcctctcggggcgtcgcggccgccccctcccgcagcacgcccctgccccgcctggccgcggaggggaaggcatctggccgcccacggacgcgaggccagggtctctcgggggaggaagttcattgccatctcgttgccccccttacccccccacccccgccgcccttggacgaaagcgaaaccttaatgttgctagcgacccgagagctccgccggcttctcccccaacccccgccagctcactggtccgcgcatctctcccctcccccctcccgccaattatcctagcgtgtttgcaaggcgaccagattggaaagagtgtggtcagagtgaccccaagccacgctttaaaagttcagggtactttgcagtagtaactttggcagctccaccagtgcgcgcaacatttctttctatgggtacatcctgtaccagtcattttgaaaccctgcttcattgtttctagccgcttcctgatggctctgtgattatgagacccccctcaaacttcaccaggcattaaggttttgtttttgcttttttttcagagaggtatcatttcgtttgaaatccacctagatgtggcttttcctgttttgattttacttaacatagcttattctctggaagttgctttaaaaagaaattgaaagtgatggttgttccttccaccaaacagtttaattttcagggtgcctcatattaatggatatgttttcccttcatagatttctcattgtttcccttatgatgggatgatttcatttattaataaaatcagactttgaaagagcatttaaaaatgacctggtttaaataggtcacacccaagaaactcagctatctgtacaagttcaaacttctaaactttttcaatgagctaggggtggtggcacccacctgtagtcccagctacttgggaggctgaggcaggaggatcacttgagcccaggagttcgaggccatagtgagctatgactgtgccacctcactggagcctgggtgacaaagtgagatcccatctcttaaaaaaaaagagtttaggggacattttctgaagtgaacacaagtagagcattctaacactattgagtgcaaggagacctggaagggactaagtggttcaaagcaggaaataaaatcatcaggtgataattaaaataatttctttcctgtggatttgtccagccatttgcaaaccaggagaataggaaaaaaaatcactagtgtagttataaattattacattacgttttcaaaggaaaattttgcaaatgcgtctccttgtcatagtctattgttatctaccccactgagagtgctggggcttccccttttcaccacgacagcatttctggttgggtggcagtcatgcagtgttgacctggtgtcccataaggcacagtttgtcaaaacactagtgggtattaggaggaaacgtgcaactctgaagcaacagagcttgccccttcttcctcattatccagctggtgataatccctgtcccccacttccctagaagacagctttgaccaggaaggctgcaatgacaatgagatgtacccctatgcagagccagatgtgggcgggtggcttttttgtggtccagatcttctaggatcttctaggatgtaaccctggcaagcagtggggagcctgaatcaagcagcatggctgttacctcttctgtgttcacagcagcatcttcagttgtcttggtgcctggagcaggcaccacagctgcctgctctgttggccaccagctttctagagtagatggtagggaggagagcaaggggctcaagaggattctgtctttgaacatgcttttaatttgatctgacagaatggcagctccctgaagtccttcctactctctccacagcatttctctgtaggtccccagtttttgctcttttcagattcccagaggactgaaaatgtatcacggcccatttggggacttcctgtatatgtgtgggtgcctcaggatcatttgttttgcccttttccagtctaccgtgctgcccttctcaagtttaatgaccacgttagtttcaatattttatatatttctcagcagttttcatctcttggtcattaaacttgagaagtaaaatctgctcattaaaatgactgagtccatggccaggcatggtggctcatgcctgtaatcccagcactttgggagtccaaggcgggtggatcacttgaggtcaggagttcgagaccagcctggccagcatggcaaaaccctgtctctacaaaaatatagatctacaaaaactagccaggcatggtggcatgtgcctgtagtcccagctatttgggaggctgagacaggagaatcgcttgaagccaggaggcggaggttgcagtgaaacatgatcgtgccactgagtccattcagcagcagagtagtgttggggtttgtatccctgtagtgatgacgaaggatttaggttttcagtcagaactgttaccttacaatttccttcactgacttttcttcctttccaacaccacattccaataaaaaatatctttagaccagattcttcacgaaagacatgaaggttttcatgcttcaaggtttttgacttttttttttttttttgaaaggagtcttgctgtgtcacccaggctggagtgcagtggcgtgatctcagctcactgcaacctccgcctcctgggttcaagtgattctcctgcctcagcctcccaagtagctgggactacaggcgtgctctaccacggccggctaaattttgtgtttttagtagaggcgaggtttcaccatcttggccaggctggtcttgaactcccgaccttgtgatccacccgccttggcctcccaaagtgctgggattacaggtgtgagccacggcgcccgaccagtttttgacatttctaagccaaaagttccatttgatgaggtcttagatgcaggggcaatgtgtcccttttcagatttcagatgtttagaaaaagatgtgtcatatttgggccaactgaaaaactcttgatatgtaggtttttatgaagctgtgcagaatgtaggaaatacattttagaaccaacaaagaggcatttaattttgagtgtgcctgtctcctttgagatgagcaacagctatttttctcttcaaaagacaatgcgtgtatttatcagcacattttatataatcagcaaatctaaacctctgaattaggtaagccctataggtttgttgccagaattagtgaatttatacatgcaaagtgcttagaacagtgcctggtacacagtgagcactcaatattatttattgctattattatgtttatttattttatacttttagagtataattttgatgttaggtttggattgctgaggccaagcaaaatttagatagaccaacccagctaatccactagaaagatatttgagggttattcccatctaaagatctatgggatctttggatatcatctgtgagaaacaacagaagtttgtagataagacagatatagattcaaatgccaccttcacaatttattagtgagggaaccctttggtaaaatgagcatgacaaaacctacttctcagctttgtgaacgtacagaagatcatgaatgtaaaatgtccatgaagtggtaggtggtcaacagatattgctctagcaaagtggttaagagcaagcaaactctggagccaaagggcctgggttcaaatcccgattctgccacttcttatagtatggccttgggcaggtgacctcacttttctgtgccactattcaatgataatattcctttattgtccaacgttttgtaagttaaatcagttaataaacacactatgataatgtgttggtaactattctttttacttttagcagaataacttaaaggaacactgcaggtaggagggttatacataatctctgagggccagctaggacactcgcccatttcccaccctttttcctgtgcaatgaagagtataagaagtgacagtgccattctaaaggactagccttgagttggctctaatttatatgactcgtgcctgtaatcccagcactttgggaggccgaggctggcagatcacttgaggtcaggagttggagaccagcctggcaaacatgacgaaatctcatctctaccaaaaatacaaagatcagccgggcatggtagcacacacctgtaatcccagcttctggggaggctgaggcagaagaattgtttgaacccagggggcggaggatgcagtgagctgagatcacgccactgcactacagcctgggtgacagagtgagattctgtctcaaataataataataatttatatgagaaagaagtcattcaaaagcatcattactttacatgtcaaattagaaaggcacaccccagtactaaagcatccttgatgatgaaaacatttagaaccactggtttcaggagctccatgcaatggtgaaacagcctctactccaagggttgttgctccctgtgggattcctgggtgaggaacacactgctcccgttggggtggaatcctgtggaggaagtggatgaagagtgtagccaagtcagtgagcctactgcatgggattagagtacttcaggttgcagtataattctgttcaggtgcatgctcactccatctggcgtaaagaacagagaaattaaaccattgattcacagagcaatatgagtagctgcctggggacttcctgtccattctggggtccccaacagccaatcaatattggccggttcctaatctgacctagagctagaggccactagcacccctccattcatcctttcttctctccctacccactcccaccagcattctgaggaggtgagggctgaagctgcagaggctgttgtactgtcagttactgtaaagtccccatcctgctctctgtagtttgctgtgaaggagtggagggggctgggaacaaagggggttcccaataagcagcttactaatacctacccttgcttctctcacttcctgatcaataattcccatcctttcttcatgtacctcccccacatttttgttctttaagggaagaagggagcagctttccatccccacacaatgttggggacatttggtattatacattatgaaaataagatttaccagattttagagatggaagaaaacttggggatgatcttgttccattctcttataagaacaaacaatatttggagaagctgagtaacttgctttttcaacttcacacttgaaagtgttttcatgaggaagttggggttctctgcagcacttggatgggagtcagggacttggattgtcccaattctgtcactaaatttggacaagccacttaacttttccagaatctagttgcctcatttcaaatattagggaaatttctaaatggcttaaaaggagcttgttagctttaaaattttatgattctaagtgtatgctgccagagatatgtagcatagcaggacacattaacaagattattgaaactgttctaataaaggacatctttgtgtcttgggtagctactatgtttaaagactgtgctaggtgggagttgtgcagaatacacaggtttgctgtagagggatagggcgtgtacacagacaactctactaacaagaacgttactagaagcttattggaatcacagtatttcttgctgagggtatgaaacataagagttctccttggaatatgaggttctatttggggcttaaagaatggtcaaaggttgagtgcaaataacatggattgagatggctttaaaaaataatcaaatggtttgttagtattaaactggtgcagaaataattgcagtttttgccattccttttaatggcaaaaattgcagttacttttaaaccaaatccctaatattatttgcatagtttatctctgttatggaagtttttattgacaagtaatgtagatattcacctgatctaagttaccctgaatcttatattagcagaatctgaattgcttataaataattatggctatgttggatgtagaacttattatttgatagtttatgaacagtgctaaggtctaatctactttttacagagaagctaagaacatgctacagctggttgaaaaacaaaaacttcaggcattgaaatgttttgtcaatgaaatggcaggactcatttgatgactgattattatcaactgatttaaatgactgaatttttggtactgtgtacatctatactctaagaaggaaattgaaagtaattctgctatgcttgttgccactatattaataactgcatcatctaaaataattgatagagctcagatttatcctttgtaataattctagtacttctttaaacatgttttgggattagcagctgtcaacagttagaacatgaaacagattctgttacaggagtagaagtcgatccagacatttaatgtcattttcacctgtgagagagagaataaagagaaagagagatcattatttatgggattatgtgaacttcaagtccgttttcattattaggagaagctgtgctttaaaggacagtcagggactttactttcatgaaatgcctgagctgtaaataaagtattgctttattttttatttcttgaacatttgaaataaaaaattagctatgagttatgttcaaattatattataaaaatttgctcttagcattgtgcatatatattatacagaaaaacacagagtaaaaagaatagacttcagttcctgttcagaaaaggtttaaaatttgaatactgattttggaaaccccaaaccttaagaattcaagaagcttacggtcttcttgagggacacctattcaaactcttaaatatggtgattgggtagaaagtgcagaaaagcctgctgatacatgccctaaaacaccttggaaaaaagaggtggtagttgcttgaggtaggacttaagtactagttggaaatagaagacaaggatggagactgttggtagatgactctccatgggtccttcctgtttctacacaccttgtaagcagggcattgagtgcctgtgttccaaactaccttttccatcatgtttctacagcaaacagtcatggaagatagaaatagagtcttcctctggagcaaagggcagacacgcttgcttcctgtacttcccactataagatattccggctccctaaactcagctgcctttcctgtaacccaccatgatacagatgtcacctgacctgtgggaattgggggtcagggaaccaagagaaatgctgactgtctggctactgtgactgccctgagtaataaattgtccttcgtctccaacccaggagtctcatgttttctaccagcaggataactgtggcgggctaacgtgttagtttgcaagtaaggtaaaatctcagaccctttgcagtttgtggcagggattatattctgaggagagaggaaccgtatgcaccatggctcagaggcatgagaaacggggaaccataactagttctctatcttcagagcctttaaaaggtgcaccaaggagggcattttaggggagaatataaagttggagatatagacacagccagattcctgagagaccttatatgccaggtagaagacttcagattgtatgggggaattattagagaatttttagcaggggtgtgatatgataaattttgtgttgattaagttactccaggaaatatgcgatgggtggattgaaggatggggcaccttttctctaggacgaaaaagaaagagtagttggtgaagtcagttagaggtagtaataggatgaagaagggatctgaatgaccccttggccattcagtgagtagtgatgctattcacctagatacagcacataggagggaaaagaaattctgggaaggagggagatgagaccgagttagctttaaaataactaaattcaggcctaggagcctataggctatccagatagaaatatttaatggcctatatggatctggaactcaggaaggaggcttccgtgggagcagaacacttgggcaccattagggtgtatgtggtagatgcattcttgtgcagcagtcaaggggatgggatttagactcaagtgcaaattgccccccatctcctgtgataagtgactgaagctctccgggcttcagtttcctagttcatcatagtgggctctagcggataaatgttacaaaggttaaatgagacaacataggcaaagtgcgtggtactcaatagaagtcagctgctgtcatcagcagcaggatcaccagaatgtggtgcttgacaccaaaagattaggtgagattgcccaaaacagcaggtgaaatgaggggagaggatgaagtcaaacacaggaagaaaagcctttgaagtatgtggaaagaaacaaccagaaaggtaagataagaaccagaagagattcaagaaggaaggtgtggccgggcgcggtggctcaagcctgtaatcccagcactttgggaggccgaggcgggcggaacacgaggtcaggagatcgagaccatcctggctaacacggtgaaaccccgtctgtactaaagatacaaaagaattagccgggcgcggtggcaggcgcctgtagtcccagctactcgggaggctgacgcgggagaatggcgcgaacccgggaggcggagcttgcagtgagccgagatcgcgccactgcactccagcctgggcgacagagcgaggagccgtctcaaaaaaaaaagaaaaaaaaaaaaaagtaaggaaggtgtggccaagattgagaaattcgtcagagcaaacaaggcagtcaggggctaaatagcctcctttaaattttacaaccttgaggacctcggcaactttaacagaatttcagtggatccctagggcaaaccaggccttacaaaccaggaatggatggtcaataggaagtggagacagtaagtgtagaccttaccttggagggaaggaagagaaagagccatggccaagggaagtttgaaatcaaaggaaatatctttttttttttttttcgattggagagacctcagttattcttttaaaatacttattgagcccctcagttattcttttaaaatacgtattgagtccctactttgagtcaggcactatggcagacacgagggagatagcagtgaatcagacagatgcaacgcctgccttcatggagtttcaccttagcatctgtccatatgctaggggagtggggcaggggcagggagctggatacaggagagactgaagatccagggagcaagtgagtaaagaatagggcttgagatcccacagacaactcagctttgaacaaaagggttttgtcatccaataggacaagaaggcgttaggatacatcaaacgtggttgttgaaaacagaaaagggctgggcactgtggctcatgcctataatcccagcactttgggaggccaaggtgggcagatcacttgaggccaggagttcgagaccagcctggccaacatggtgaaaccccatctctactaaaaatacaaaaattagccaggtgtggtggtgcatgcctgtaatcccagctacttggaaggctgaggcaggagaattgcttgaacccagggggtggaggttgcagtgagccacgatcgtgccactgcactccagcccgggcaacagagcgagactctgtctcaaaaaaaaaaaaaggaagaaagaacatagacagggaaatgtagttaagggagtttgggtttgggtttggtagaagcgttttctgttttttgtttgtttgttttcagaaagagtctcactctgttgtccagactggagtgcagtggcacaatcttggcttgctgcagcctctgcctcctggattcaagcaattctcctgcctcagcctcctgagtagctgggattacagacacctaccaccacaccaggctaatttttgtatttttagtagagacggggtttcaccatgttggccaggctggtctcaaactcctgacctcaggtgatccacctatcttggcctctcaaagtgctgggattacaggtgtgagccactgcacctggcctaacattgatatctgttgatgagaagaagccaggtgttggagtgatagcttatagcacatgaactgaataaaacagtgtttaagacaatgtttgcaacataataggcactgaagacatgttaatggaaggtggatttgtgattcagaacctctagactacctgggcgagtcttttaaaatgtaagtaatatcttaagtgatattacttgtcccagatcagttgtttaaaactgaggtttaatgctgtcagagtagcactgtatcgtcttctatcatgggggcctttgttggctttaggaggtttgtgtttcatagtagtttcccagtgggctctttgttacctgtaatgagtgtgacagttatgccataaccaggttttatatggaatacaattttgagaaagttctttctaggcagagaagcttatttgaacctcttattatatttgggtttcaggcttttgagttcttctgaaataatagccctttgaaggtagctattgctatgacttcattaaattctaatgcctctggttttctcccccaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtaagtgagatggagatccaaaagactaaggtgtggctggctggtttttattgtatgggggtcaggatatttattttaagtatactgaaatgaataaggaattaatgctgcagttataaattgattacttagctgaatttttgttttatggtgatagtttatagttttaaagcacatttgaaaacagatacgagaaattatcagtttttgagttcaaaaattcaagagaaatcagtctaaaactactaattaagagcagaagtgttaagatgtacattatttcagatgaatgttctaaagccatgcctctcaaactgaaatgagcttgtgagtcacctggggatcttgttaaaatgtgaatcttgattcagtaggtctggggtggaccccaagactgcatttgtaacaagctgccaagaaatgctgatgctgcccttttgcaggttgcactttgagtggcaaagttctaaatctccacatttgtaatcctattaagaaaaatatagtcattcgtaaactgtgtaaaaatgctactggccagtttcccaaggcataatgttcacttaggcaaaggtcattgataagaacgctggatatgcatctaagttttgatgcgatcaggggttctttgtgtttttttctttcgcaaacctcaggtcagatctgattagcttgttattatcacatgatatggctgaaaaaaaatgtgagacatggtaaaagttctgctctttcctcgttcatttgtgcttgctttgttattagcattcgttgtagctctgggcaggactcatttgaagatgcttgcccattttatgaggattagcttagataaaattgaaaatataatgcaaatagcaactttctcagttgggctcagggctccacagctaaccccatggactgtggagtcttgccgttgttttgggtgccaagcaagccaagtcacatgtgattcaagctgtctgccacatgtacagggcgaggatgcgagtgtcaatccacctgttaactgtcagtgaagccttgaaagcttctcatattttcaaggttaaaatctggatagaaatgctaaagttttctctctgcactccattaggttattttatgtactctctagggtgtaaggaccttatttagaaattaatattcttggtatcaagtagatgcccttttgcttgttcatttgttggttcttctagtcattcagaattgctgttgcaggtactgttggagatgatattagcagaggcttgtaggaaggcaggagcatcagtggggaataggaccaggtgatctatgtataggacataatggaaggactgagaagggagcctaacacacacccaaagggtagagaaggctttgtgaaataaaggctaatatggagctcaaaaccaccatttcactcacagaatcaaactctcatattataaatcatttcatgttattgtccacacatctcaagtgggcacggcagcatcaggcttggagattcagagggactaacttcctgtactctaatcctacttctgcacccataaactgggtggcctcaggcaattgagtctgttttcttatctgttaaatggggataattacagtatttatccaatagagttgctggaaagactaaatgaggtagcactcgacctgaaacttagtaagcatttatagccataaaaacattttcattcaagaaaattttactagaggcagattatatgctaatttcatttcacgtcttaggtaaaaagaaacatgatacctagatgagtgccttcagctttcaaagatgagattctggtcatatttgaggaacattttaaaaactacacgtataacttaatggctcctattatttggacaaattccagaatgaaaatgagaggactgaacagcctgtacctcagtccagctctatatagtatttggactgaatttccttggggagagtttgtgcgtggaatcgttgttcagcattttacacatttgactctttcccaaaatcttttacggccatctgagaataggcttctggccagtcattcggatgcctgacaagagaaagagatttataaccaaattctgtaattgggacttccagtctttccccaagtagagaattggacttactctatatgctaaaaacccatggttgaaatatgaattagttcttaagtgatttttggcttgcataccatttttgcaaacacaaattgtcattactctgctcatttaataaaagaataatttgtagtataggtatatacctcaatcagtgattttgttgttggaaacagaacagtaaatcacactggccatgatgctaacagcgtgatagattttctgttcttgggacaccaatgtcactgtatctcatagcgaaggattatctgctgtaggagcattctcttgactacttataacatttgctgggtgaaataattctccaggttaaggcctcttctaaacagatgaggtcagcactaactgcatttgccagagaagacatatgcatttactgccagcatcataaacacaaaactacagtttgcgaggaaaccctttgaccagcatctaattaattcactgagtaatgtcttgggagaagaggcatgtaaaggaacaattttataagcatgccatgagattgttttctattgtatgttccatagaatatgaggaaacttcaaaacattttgtggaaaaattgaattaaaaagtaaaaaacacatatatacataagctttatttctcaagataaactttatcaagttcaagacacttttgtaagcaatgttaacagccattgagtcggtctctaaagaactgagggtcctgggaatttaaccatgtttatacagtcttttatacattattaactggagaaaaattggcgctctttaaagattttttaaaattgagaagcaaaaggacgtcagaaggagccaaattaggcctgtaaggtggatgcctaatgatttcccatggaaactcttgcaaaattgctcctgtttgatgagaggaatgagcaggaacattgtcatggtggacaaggactctggtgaagctttcccaggcgattttctgctaaagctttggctaactttctcaaaacactctcatgataaacagatgttatcattctttggccctccagaaagtcaacaaacaaaatgccttgggcatcccaaaaaactattgcaaccatttgcccttgaccagtccactttcgctttgactggaccacttctgctctcagtagccattgcttaaatttgtcttgatctttaggattgcgctggtaaaactatgtttcatcacctgttacaattctttgaagaaatgcttcaggatcttgatcccacccgtttaaaatttccattagaaactctgctcttgtctgcagctgatctgagggcaatggttttggcacccatctagtaaaacgtttgctcagtgttaatttttcatccaggattgtgtaagctgaaccagcagagatgtctatgatattggctagttggtcctcttcaatgagggcatgaacaagatgaatattttcctcaaacaattatctggatggtctgctgctgcaggcttcatcttcaatattgtctcgtcccttctttttcttttcccccccgcttgagacacagtcttgttctgttgcccaggttggagtgcagtggcccgatttcggctcactgcaacctctgcctcccgggctcaagcgattctcctgcctcagcccaccaagtagctgggattacaggtacacatgatcgtgcctggctaatttttgtatttttagtagagacagggtttcaccgtgttggccaggctggtctcgaactcctgacctcaagtaatccacctgccttggcctcccaaagtgctgggattataaacatgagccaccacacctggcctcatcctttcttaaaatgagttatacatttgtaagctgctgatttctttggacattgtgcctataaactttttgtaaagcatcagtgatttcaccattcttccacccaaacttcaccataagtttgatgtttcttcttgctttgattttagcaggattcatgtttctctgatagggggtcttttcaaactgatgtcttatccttcttagagcctcatcccagatcctgttcagacatgctacaagttaatacaagtttatttggtgccaaaaaatggaaatccatgcatagtttttaaataatatgcatttttcatgaactttttgaagaccccttgtatacttaaactgctccacatggaaaagcttccatgatcaaatgcagtaaggcagcatctcaaacattttgttctaaggatttcttttcactcctcaaagttgttaaggatcccaaagaccatcggtttatttgggttatatctactaatatgtactctattagaaattaaaactcagatattgtaaagatattaatttgttaaaaaacaaaagtaataaacatctacatgttaacatgtttttgtgaataactatgtcttccaaaaaatatttagtaataagagttttacattttttcaaatctccttaatgtctgaattaatagaagataactggattctcatagctgattctctattcattctgttgtgatggattgtttaattgaatatatgaagaaaatttggcctcacactgctacatagtaggaaaatggagcactatatccatagcctttttagaaaattgtggatctttttatttaatgctacaactcgacaagtggtagtttttagaaggttagctgtaatatgaaatctgaaactatatcaaagtattttttgcactttattatgttaaaatccattgatctatctagcagtttttttttctttgagacggagtttcatctgttgcccaggctggtgtgcaatggtgaaatcttgactcactgtaacctccgcctctcgggttcaagcgattctcctgcctcagcctcccaagtagctgggattacaggcatgcaccatacatgcaccataggttacattttctcctaacacccatgaacgtccctcagaatgtgtgaacacagtggcataaggtcctgggttaaaatgtagtgttgcctttgagtccatggtaagtaaacatggtaagtaaatggacatatccactctggaaactgatggttgcatgagtgaccctgactagatctttacctcatcacatcccaaagaaatcaagagtctgcccagactcagacctagaaacattctcaagtctaagaaaatcatctcagggttcttcttctctccagttcttcagccttgtctcttctacaaaatctctactcagaagaaaatccaatctgcccctcatactgattgtcattttagatcattcataaaagtaattgcattttcattcttttctttatccacggaggaaaaagctctgcttcctttaaagggactttccagcactgaggagcaggtagcagaagtgttaggctggggcttctgacattacatggtgctgttttacatcagtcaaaggaaagaggggattttgagtgggaaatggcgggggttcttgagatggtaataggtggagaagtgcaggctggtgtgtggtcgagggcagtgggcagagtgtgtgccgggcccagggtaagtcagagacagtgtacatggaagtatttttggtgtaagcgccttttttggggggtctctctgtcgcccaggctggaatgcagtcgtgcaatcttggctcactgcaacctctgcctaccgggttcaagagattctcctgtttcagactcctgagtagctgggattacaggcgcccgccaccactcccagctaatttttgtatttttagtggagatgggttttcactatgttggccaggcttgtcccgaactcctggcctcaagtgatccgcccgcttccacctcccaaaatgttgggattacagacatgagacacttgtgcctggccacgccaaatgttttttaactggcatttcttatcgcactcgaaatatgtcatggctcttcaagcactgttctcgactctaataagattgtgatcctctggatttggtgtccactctgaacgcggcgtgggtgtttaacaactgtgacgggacagatgtcattaatgtgaaaatgctcgcagccttccccttttccaccctgctaaaagaatctggtaattgctagcctggttcctccctctcccaaaaaggaagtcttatttcttgctgggagaaaggctaagtttgagggggaacagtgcgatacaggagcatggggcctgggtggagcgggggagagtgaaacagagcagctgcgtgggaaacagacatgtagaaatcgactttattaaacgtcgctggagaagatgtatttggattccttttaatgtcctttgacaaaacgggttttcttttctatgattcttggcaatgaagctgcatttcttgaaggtgacacatatctgagactgaaccgtgtgggctcccttaccactaattttaagactacttgactctttgtagatttgattttaaaccaataaatgtttccttttgaaatttcctgtaaggaaccagtgtattcttgcatgaggccctgtaagcacatcgcctttcccagtaacggcataggaccttgtgcctcctcacccagcctctctgggctgcatgttacctcgcatattaaacaagaaggcagtctgaagctgttttcttgtgattagcaggagtccatcccccgtatcaaaagccattgttgccttggctgagttttattacttaaatgtaaaaaatttttgaaaccttatttttgagtgtcgctttgtatcattttgtattttacccattactaatttgttttaataattcaccgtctgcttggaattttaagttggccacttaatatatgcaccattacttcaggattttcaatagagtctggcttcaattgcatctcttgcttggctgttatatttgccggctcattactttctttcttcgctagagtgaagatcgaagattacaacacagagctagagcattttgtttctgagggtgattattttgaagaacatagtattatttttcaaatattctcacctcttcccccttctacatttggtcataatttctaaacttcaaacatttgtctcttttgctacacaggtaatgattctgagggggtcttgttaggtatgttttggaggacttcttacctatattaaatttccactgggcacctttaatcccagcctgatttattatgtaaattttcatttggggtcccatgcagcagctatgactcagtgcagtgtatccatgtcagctaatcagcacttgactgtctgtcacactagacagaagttggttgctgggtgcaagggctggcaggaattttttcgtctataaaaagaatgtccgggactgcatgaactccgaagtatttgttggaaggtttgggttcttaacaccagattgattacctaatttatttttgactttgaaaaatgagtctgtgggctccagaagcatacaccttgtgatagatgcttaattttttaaagtctttttattgttttacacatatgactttatatagctttgcattttttaccaaaggctttgagtttgataattattttttaaaataaatccatccctaagaatagactttacaagtgtcttgcacctaaagttgacttgcatcttagggagatttatttatagcttaggtctttactgtcccgtacagtaatcagtagtcatttgcaactactgagcacttgaaatgtgaccaatctgaaatgagatatgctgtaagtataaaaaacacagtggattttaaagacttcatttgaaaaaatatgtaaaaatctcaatagtttttttataatgattacatgttgaaataatattttgggtatattgggttaaataaattacatgactaaaattaattttacttatttcatttttaccttttaaaaatatgcttactaacagaaagataaactttgcatgttctcacttatttatgggagctaaaaattaaaacaattgaactcatggagatagggagtagaatgatggttaccagagactgggaagggtagtcggggctggggagtgaggggagatggttaatggtacaaaaaaaaatagttagaagaataaataagatttagtatttgatacaacggagtgaccatagtcaataataattaattgtacattttaaaacaaaagagtgtgattggattgtttgtaacacaaaagatagatgcttgaggtgatggataccccatttatcctgatgttgttgttacacgttgtatgcctgtatcaaactatctcatgtaccacacaaatatatatacctactatgcacccacaacatttaaaaataaaagatattttaaatataatttttaaaaataaaatgtgcctactagataattttaaactacgtatgtagcttgcattctgtctcttcctgttagccatggactagactagcttcctaaaaagtatttccagaagtaataggaatattcatcacagagtgaccgtaggttctcccctcctcctttttttttttttttttttttttggctgcctttcatttgttaatgactgaatgttgctcagagttcttccataaaggtcacttaagtctagaaatatattgcagtggatcagagccatgtgggccaccattttaggatatactgaagtagctaaatctcttgtttctcgcttttctctcttctgaatacctttcctccctttggaggctcaggcatccaccctactcattgtggtctgtcagcttcaacccacaaccacagaaggtgccgtgccgggctagcctggcactgggaaaacttcagaagacactggattggggttgagatttgggggaggagcctgatgcaggattttagggaaagaggtggacttgagtgtggttgctgatgtgcatctgaagagtgatttggtggctgcccatcctgcagggaccctttcctggccgcttttattctgaccatgcattggaagttgtcatttcttaagatcaggtgatgtaggtatttgaaattttgcaggtttggtgttcattcatttattgaaatactaccaatgtgttggtcatgtgttttgctgggtgctggggtacaaagccaaacaacgcatgattgtgccctcaagaactataatggtgttttatgtgccaaatgtaagttctgaatgccatattttcaggagttagcaaacatctgcaagtcaggaagaaaaaatttgggagaataggaggagggctagtgtaataaatgcctgcagttgtttgaaaagcttcatgtacaaaaagcaagagacgaactatgaattgctccagagggcagaactaggaacagtagaaatttgtagagagatttttggctcttcctgagtataatagccatctaataattacataggttatactgaacagtggacatggatggatcttgtctcaggactttcgcaagtcattctctatttccacacttcccagtctaaggaatatcctacctgacaatgctcccctctctgtttcagacaactaaagtcgctcctaaattcatttcatgttgaagggaagttgttccctgtaatatctagctgttcatcgtagatgtatcttctgaaaggactcagggtaaatgtaatttattttccatgggacattcgagtgggttttaaaggactactggcagtttcccaggccaatgggttgggtgaggattgaatgtatgctgtaagtagaaaatatagtatgtgccatgccatagcaggatggggaatgatgagatgcccactgtagctgggcctgctgggttagagttttacaacttgcatggtcagagatgagataggaaggaagggctaaggccagattttacagggctttgtatgccttgctgaaggagttggacagtcccctgaaaaagaaagttgctgctgtggtctgaatgtgtcttctccaatatgtctgtgttgaaagttaacgaccaatgtaatagtattaagaggtggggtctttaagagatgattaggtcatgtgggctcctccctcatgaatgctattatgatcctataaaagaggcttcatgaaacatattaagccctgcttccttcttctactatgtgaggatgcagcaacaaagctccatcttgggaggagagactcaactctaccagacaccaatcctacctgagccttaatattgggcttcccagcctccagaactgtgagaaataaatttctgtgctttataaattacccagtctcaggtattttgttatggcagcacaaacagacgaagacagttactattagaagcactgatcagggaagtgaaatggattaatttatttggagaatttggagtgaaggatggaatagagggatgagagacagatgagggaaactagttaggaggctagcacagtagtcgatatgaaaactcaagaagcatcttacccatagtgtaattaggaagtagcttgttcttgctgagtccatgctgatgtcttctgatcactttcccctcaatacccaacagagttttaatagtctgttggtctccagtggaagagaaagtcagacagatcctaattctctgtcctattgatgcttatatgcttggttcctaaggaatggtatgaaaaataacatagaagtgaaattcctaacctgattttgctcagcctcctaaaaaatatattcagggctgggcacggtggctcaggcctgtaatcccagcactttgggaggcttaggtgagtggatcacctgaggtcgggagttcaagacaagtctgaccaacatggagaaaccccatctctactgaaaatacaaaaattaggcaggtgtggtggcacatgcctgtaatcccagctactcaggaggctgaggcaagataatcacttgaacccaggaggcagaggttgcggtgagctgagatcacaccattgcactccagcctaggcaacaagagtgaaactccatctcaaaaaataaatatatatatatatgtgtgtatatatatatatgtgtgtgtgtgtgtatatatatatatagggatatctcccatatcaccctccgatgaccccacatcccattccagctccctccagttactggcccaatttttttttttttttccttcaagagttatagtggctaccttcacctgcactcccttgccttttctttggtttaccagctgggcttctgacctcatcattccactaaaattgctcttataatgtcacgagccacctagagcttgtgagatatagtggtcccttctttgtacttttcttactcaacttctcagtagcttttgtcatagtttggcaagagaatgtttcttctatcttgaaacactctcttttggctcttggagaaccacacctgcctgtttttccttcaactttctagtagtctctacccagtcttctttgcttctacctcttcttctcaattctgatttttatgtcccctgagaacttggtctcctacatttctcttctggacacccttccagatgaactcatccagtcttacagtgttaactaccacctaattgatggtaactctcagttgttaatctattacttcagactcttcgaagagctccacacttctctattcaactgccattgtgacttttctagttggctgttaactacacatctcaaactcaacatggctaaagtagaacccttgattccactccctgcaatctgtttctttcccagtcttcttctatagctctaagtggtgatgactgttgctgcagccaaagcctaggagtcgtcttcgatttctctttttccattatccctcatccaaattattcaacccattgcaaatacaccacttcctttgctccattacagagcccaagcctgaggcgccattatatcttatctggactactgcagtgtctccaaactcatccctttgtttctgttcctgcttattctttccaccagacatccaaagacatcttctaaaacccaatgaaatcatgccattcccctgctcaaaacctctctagtggcttccccagtacttagactaaagtcctgtatctttgctggggcctatcatgtagacttcatctcccacacccttcccgttgctctctggactccagccaccctggtgtttatattgctcaaacatgacaacctcattcttcacctgggatctttgcatccgctgttgcctctgcctggaagcatggctgcttccttaggtcactatggactcagctcaaacctcgccctctggccacccactcaaaagtagccccacactaagcaatatcacttcatccagttttaatgccttcatattactcatcattatctgaaattatcttgttcagatattatcattgtccaaattatctcgttcggaatcatatgcttccatgttaaccacctacttacctgcctgagctctaagagagcaacgctcttgcctgtcttcttcactgctagtccctggcacctggaacagtgcctggcacatagtagatacttcatgaatgaatgaatgaatgttacctttttgtattaattcttgaggatgtactcttcctttctattttttttaacctgatatcatctagaagctcctgtattagtcagcattctccagggaaacagaaccaataggatacacatcataaagtactggctcacatgattatggaggctgagaaatctcatgatctgccatttgcaagctggatacccaggtaagccagtggtgtagttcaaacgcctgagagctggagagctgaagtcatagattccagttgagtctgaatgtctgtgagccgggagaaccaagggaaggggaagatcagtgtcccagctcaagcaatcaggtagagagcaaatttaaccttgctctgtctttttcttctattccagaccttgaggtattgaaatatatactttaacattggggagggctgttgctttactcagcctgctaatgctaatctcttctagaaacaccttcacagacataccccagaaataatgtttaaccagatatctggacatcccatggcttagtcaaaattaagcatcatcacgtcccctgtgcacccatattaatttatttcctcatttttcctttcctccttcatcaggacagactcctgttgttcagccaggattttgttcttagaagccacccctctctccccatccttcctgagcttctttcccttagagttttgttcatggggtaatggtcatcatctctcagctctttggaatctgcaccattctcttctttggtctgtatgaatgcaaaattttcttggcatttattggtgacagttgtggaagagatgtcatgaaggctgagcagcctttactgttgagaaaacccttgcgtgtagattaagtccttttagatgcaactggagcccactttcttggcatccatctttttattctgaaatgctttttctgattatacaagagttgatgctaaatgtaagaaatgcattcatacaaaagagttagaggcacaagtttcccctgactcccatctcctagagggaaaccaacattaagagactggtgtatatctttatacattttactgtcttatttgtagaaacaaatgtttctgtatgaaatcattttttatatccttttctaccatttcttttataactcagctctctctcttgttctctctctctgtatgtgtgtgtgtatatatgtgtatatatacatatatatatacatatactttaaacatctttttatggtgatagaggtgcatcgtttttagcaatttcgtagttgtcccctgtatgaagcagggggaaaggaagggctagtttcatgactgaagcagagctgctgtttgggcaagaacatcatctttatttagctttcataaaccatcttggttgtgaaaagacagcacagccaggatgggctgaaagtgcttggggatgtctaatctgcttagcataagcaaccaacaagattctggagaaagtcaggactcaagagtatgcaaatcaggagccaaagtcaaattcctatttttgatggtgagcagggggaatgactagtcttttaacaacgggagggctgatgtttagcttttagttagctgctactgttttgttttgttttgttttgtttagttttcttgagacagtctcactctgttgcccaggctggagtgcagtggcatgatctctgcacactgcaacccctgcttcccggggtcaagatattctccagcctccgcctcttgagtagctgggattagaggcacatgctaccacgcccagctaatttttgtatttttggtagacacgggatttcaccatgttggccaggctggtcttgaacttctgacctcaagtgattcgcctgcctcagcctcccaaagtgctgggattacaggcgtgaggcaccatgcctggcctgctgctatgttttgtatgttgccacagagtgtctgagtatctcactccctcctctgtggcctccctttgctcatttccccaaatacctattacagtttaccacatataagaagttgtgtgggccaggcatggtggctcaagcctgtaatcccggcattttgggaggccgaggcaggtggatcacgtgaggtcaggagttcaagaccagcctggccaacatggtgaaaccccgtctctactaaaaaatacaaaaattagctgggcgtggtggcaggcgcctgtaatcccagctactcgggaggctgaggcacgagaattgcttgaacccgggaggtagaggttgcagtgagccgagactgcgtcattgcactccagcctaggcgacagagctagacaccatctcaaaataataaacaaataaaagaagttgtgtaaacactatttgtgaacatcaaagaaaggctctgtgtggtgtgtctgtccacagtagatggggatggaggagccatgggaggccgcacagggcagagagccaggattcactggggcagggaattggactaactgtggactcccaagaacccctagagagtttgggatggatgccgggcttctctttccccatgagaagggattttgatccaatatttaaaatcttccgaatgacagaataacccttgctgctatctggactatatacttttgtaccataatttagctagttcctcttcatgatcatttagatttttccaattttccccctttattatacttttctcagcaataaaaatattgcatctgcttccaaacagatacagtcagtttatatacactaatagatacagtgctccccacctcaaaaaaaatagacgaagctattttgaagatgatcccctgaggagctggcatgacttagagcccatagttgccctgtgctacttccatgatgttaaatttcaaagcagagattacattttaattataatagcatgctttagagggattcacagcttaaaaaaacaactggaagcaaattgtacatgcaagtgattaaatgtcttatccatgtgatttccattctcaaagcttgatttataacacttggattcctaaaatctgttcttgcctttttctttccaccatattatgagttatctcagactgctcatgataaatgaggtgactaccactgatttttacaatgacaaaaagaaaagaaaagcatgtttcatatcagaaagttgtacgtagcctttgtgcttcatgaagaaaataaaattatgctaaatacgattttagatttttcttttttggcctgtatgtatgttttaaacagtgaacaaacaaatgtgatcacggtgtgttttggcattttcctctttttttttttttttgagatggagtcttgctctgtctcccaggctggggtgcagtggcacaatctcagctcactgcaacctctgcctcccaggttcaagcgattctcctgtctcagcctcctgagtagctgggattacagatgtgcgccaccacgcctggctaatttttctatttttagtagagatgggttttcaccatgtttgccaggctggtctcaaactcccgacctcaggtggcccgcctgccttggcttcccaaagtgctgggattacaggcatgagccaccctgcctggcctggcatttcccttgtaagcctagccgtacaatttttaattagtctctaaaaccagatgtacaagtgtacagttcccctgtcaactataaatgatgtattatgtgtattctgtacaacacatactaattttaatttcctactacatttctagtatgtataacattatgaaaatgttcattagcataattcaacataattgctgaggactgttgaataaatttccttctaaggttttagatgatgttctactccttataatataataccaacaacacagagaaaagttgtgcaagaaaatgattcctatctggaggcttgaagacttacgcccccatctttaaaaaaaaaaaaaaactggaaatgtacagtttgaaaatgaaaggttcaggagaagaaataactcaaagaattttaaagttatagattttattttattttgggatgaagtctcactgtgtcccccagtctgaagtgcagtggtgtgatctcggctcactgcaacctccacctcctgggttcaagcgattcccctgcctcagcctcccaagtacctgaaaaggcatgtgccaccatgcctagctggtttgtttttgtttttttttttttttggtatttttaatatagacgagggtttcactgtgttgggtaggctgttcttaaactcctgacctcaagtgatctgcctgcctgggcctcccaaagtgctgggattacagacataagccaccgcgcctggctaaggttatatattttaatttgatcacagtttctatgcagttaactactgggaaaagcacaactactcctatttaagactcatatgtgatcactggttaaaaaaaagagaaatacatatttctcaaaataagtaatgtaaatgcagaatctgctgtatcatctgtttcatagtttagatatatgagcttcctcctcttttgacactatcaatgctaagtgatcacattaaataatctgtgctgatagttaaaagtaaaattattttcatcacaagcagaatgttcttatttagcttctccacagctggcgagaattggtttagttcagtaaacattaactatctgtggccaggcgcggtggctcacgcctgtaatcccagcactttgggaggccgaggggggcggatcatgaggtcaggagatcgagaccatcctggctaacacggtgcaactccgtctctactgaaaatacaaaaaaatgagccgggcgtggtggcgggagcctgtagtcccagctacttgggaggctgaggcaggagaatggcgtgaaccggtgaggcggagcttgcagtgagccgagataacgccactgcactccggcctgtgccaaagagtgagactccgtctcaaaacaacaacaacaacaaaaaacattaactgtctgtgtgccaggcagtgtgctaggcttagtgggtacaaaaacccaacaaaaagcccgtgtcgttgaagcacttagagtccggtgggccctggggttggggggtgtagtttgaaggacagtcatagacaggtgcttcaatgtcatctcgtaagaggtagtaaggtagagttctgtgcaggccactaggtgagctctcttccacctggggttctgcaaaaccaccttggagccaaatctttaaggaggaataagaaccgggtaaagagacaaaacacagagccagtgtgagctggggagtgcagaaaagaggagggagaatgaatgagtaggcatctgtccttggccactgcctgagatgggaaataggaagtaaaaggacttggaggcgaggggccgatgacttccactgcagatttctggggtattggagccgtttgagggatgttcaatgggctgaagttcagcggagtgggcagggctggagccatgcaggtggagcatacacatgggagtcaaaacgatgagagaggttaatatcccgggagcaaggaacactggggaatgtgagtgttttaagaagtgggtaagggaagggagtccacaaaggaacatgaaggtaggaggagacctatgggaccgcattgtcccaaaacagtagggagttttaagaatggagacaaaggggccgggcgcggtggctcacgcctgtaatcccagcactttgggaggccgaggcgggccgatcacgaggccaggagattgagaccatcctggctaacacggtgaaaccctgtctctactaaaaatacaaaaaattagccaggcatggtggcgggtgcctgtagtcccagctactcaggaggctgaggcgggagaatggcgcgaacccaggaggcgaaggttgcagcgagccgagatcgcgccactgcactccagccagggcgacagagcgagactccgtctcaaaaaaaaaaaaaaaaaaaaaaaaagaatggagacaaacgacaacagtgtcaagagcagtaatgaactttgtaaaggtaatggctgatgaacatcccacagatctggcagtgcgggtggtcactgatgacctttggcagtggagtaatagggcatagacgccagattgcagagaggagtggatggtgtcaaggacatggagaggccatctgtgacttccaacccaggaaaaaaaaacataaacatatatgttttatatgtatattatatacataatacatatatatacaaaatacatatatataatttttttttttgaaatggagtctccctctgtcgccaagctggagtgcagtggcgtgatctcggctcactgcaacctccacctcccaggttcaagcaattcttctacctcagcctccctagtagctgggattgcagacacgcgccaccatgcccagctaatttttgtatttttttttttagttgagatggggtttcaccatgttgaccagaatggtctcgatctcttgacctcatgatccgcctgcctcagcctcccaaagtgctgagattacaggcgtgagccactgcgtccagcccatatatataattttgattttgcctgtcctgttttttgggggctagggtgtcatgagttacaagtggcacaatcatagctcactacagccttgaacttccaggctcaggtgattttccaggctcaggtgatcttcttgccttagcctcccaagcagttaagactacaggcgtgcacaccatacccagctaatttaaaaaaaaaaattgtagagacagcttctcgctatgttgcctaggctgcttatgaactcctggcctcaagctatcctcccaccttggcttatttaagtgctgggattacaggtgtgagccaccacacccagcctcttttcctgtttttatctctactcttaaataggatacccttccacttttttttcctcctttttacctcccctgtctgctgacattaaaaataataaccacaactaatttgcatggttctttgtaatttataaaatactttcacgtatcactttatttaatatgctcacccatcttttgttttggtatcataactaatttacagttgtttaggatggaggcccagacatacagattcctatgtgccttgtaattcaacccgtcctattgaggaaactgaggctcgggcttatgtcctattccatcactgtttagaggggttctggctttagaagctaacctcctgattttcattgtgtaactctaactacaaggtggagacactggggaggctcaggcaaccctgttagaactcagtacagaggaactctgggcccataggcaaccaagagcctgtgcctttaagccgtcctgaatcatgtgctagttactggtaggcagtaagccagaccacagaccctccaccctcatctgtactcgtctgagactccctcgctttgttcccactcatgacctctgcttattctcagttctttttctgtttctatctagcttcctacactttgaattttgtctcctgctacagaatattcctcctttttgtccaatcggcatccattctactgaatcaatcaacagcacctctatatagtccactggagatggcccatggctaattagcctattctgctgccctggcctcaatgattggtttgggggtgggcttgtgatccaaaccaggcaaatcagagtcaatcctggaaaaagaatctctcacaggggaccctatggctgctgcctgtgtgaacgaagacaataaggaggtgccacagctaatggatggggtggcaaagttctctctcttttttttttaattatactttaagttcttggatacatgtgcagaatgtgcaggtttgttacataagtatacatgtactatggtggtttgatgcacccatcaacccatcatctacattaggtatttctcctaatgctatccttcccctagccccccaccccttgacaggccctggtgtgtgatgttcccctccctgagtccatgtgttctcactgttcaactcccacttatgagtgagaacatgcagtgtttgttttctgttcctgtgtagtttgctgagcatgatggtttccagcttcatccaggtccctgcaaaggacatgaactcatccttttttatggctgcatagtactccatggtgtatatgtgccccattttctttatccagtctatcattgatgggcatttgggttggttccaagtctttctattgtgaatagtgctgcaataaacatatgtgtgcatgtgtgtttatagtagaatgatttataatcctttgggtatatacccagtaatgggattgctgggtcaagcaaggttctttaatatcctctgcacactgggatccaacttattggagctggaagtctccctgcacttttcaagtgcacaagccaatgaagtccacatgtatgtttaattccatcgaggtgagtggcagttgtaaccacaaaagccttaactattaaactattattctcctgctgcacccccaccccatttttttttttttttttttgagacagagtctcactctgtcacccaggctggagtgcagtggtaccatctcagctcactgcaacctccgcctcccaggttcaagtgattctcctgcctcagcctcccaagtagctgggactacaggtgtgcaccactatgcccagctaatttttgtatttttggtagagatggggtttcaccatgttggccaggctagtcttgaattcctgacatcagctgatccacccacctaggcctccgaaagtgctgggattacaggcgtgagccaatgcacccggcatagtcacctctttttagcctcatttggctcctgtgtcttgctgggactcactgtgatcgatctttgcaatctctagaatttgcttcagacccagtcgtcttactctcggcttccttaggtaccctacaccttgctggctcctgcctcagctcctgaggctcaagccctgcgctctaactggtgtcactgccatataccagccctctcctcccccacaccacccctgccatgctccctccccaaacaatctcatgggatattttctcatcacagtgctatgagtcagttcaagtttatgggttgcctatactttgtttgtatgaactgattttttctgttattaataatgacagaagaaatatctaccactaacccaatacttttttgttgcagtaaaatatgcataacataaatccgtcattttaaccatttttaggtgtgcagttcagtggcatcagtatattcactgtgttatgccaccattacactacccatttccagaactttttcatcatcccaccagaaactctgtagccattaaaaataactcctcactgctccctgcctccagaccctggaaacctcttttatttctgtctctatgaatttgcctattctaggcaccttatatatggggaatcccatatttctccttctgtgtctggtgtatttcacttaacataatattttcagggcttgtctatgttttagcagtatcagaattgtattcctttttaaggctgagtattattcccttgcatgtatatgccacattttgcttatccatgtatctgtcgatggacatgtaagttgtttttaccctttggctactgtgaataatgctgctgtgaacatgggtgtacaaatacctgtttgagtccctgctttcaattcttttgggtacataccaagaagtggaattcctgggtcaaccaagcatgtgctatgtattttatgcgcattattttatttactattcacaacaactctatgtggtattattattcctactttaaagctgaggaaactgagactcagagaaattaacatgccaacgacacatcctgtgctatgctcttgctgctgctactcataaagtcatctctccaagccgtgaaggaacacacatgcagcatacactgtctgccaggccctgggctccatgccgaggcacacagtcacacgtcatacctagtgttctctcccgtgaattcgaagaaagtgcgatcaccctgtagcatgctgcatggatggtgcagggccaggtctacctttcacacatggtgtcttgtctttgccatttacactgctgggttttattcttgccaagccagtgaccaattttaccagcctctttcatttcctaacctgaaccaacgctgtctataggtggaaggaacaaagaaacaagtgaagaaaaaaaattatatattacttctgattataaaaatgatacgactggttgtggtggcttacgcctgtaatcccagcacttcgggaggtcgaggtggggggatcatgaggtcaagaaatcgagaccatcctggccaacatggtgaaaccctgtctctactaaaaatacaaaaattagctgggcatggtgaggcacgcctgtagtcccagctacttaggagcggaggttgcagtgagctaagatcgcgccactgcattccagcctggtgatagagcgagactccatctcaaaaaaaaaaaaaaaagagagaaaaaaagaaaaatacataatcattgcagacaatttggaaaaaaatagtaacatattaacaaaaaaaacagaaaccaccctataatcatgccacttgagataactgttctaaaaaaaaagtttaaaataaattaataatatgttatcatcaattagaaaagatcaaagtagtttggtatcaatttactcaataaaacaaaagagagaaattggccctaaatatttccccatctacttttgacagatttaaattattcaattcagttactgcagatttatgtctttctgtttgaaggacatttatcctacagaacttgccagatggtgccctgcaatggctctatgattatccatcatcattagaagaaaatgctccgtaatctgtgtgcattaactttaactatttggaaggaacatgtgtactttggaagaaagctaccacatggagaaagtatacaggaagacctttctagtggtaaacattattgtctgaactcgaatgccagaggcagaaatgacactggatttacaccaggataaggattccctccctttgtgcctccatagggtactttctgcctgccgtcactttaggtcaggttgctgtggctgctcaatgccttagcgttgctctatagggctgctcaagccatatggcacctctgtacaaattacaaagtgccccttccttcctgtgaaaggaggtggccttgctccatcgcttggtcagcagaagggtggtgagttcattcttcacctgcatctttgtccaggtaccctcgttcagcaatcaaaaactctatgtaatgatcctggctctgcctttttgaggcttcccttcctctgggggtgctgatgctgtggcatattctagatcgaggtgatgcggccccacttctaggtgagccctggtgatgtggccctcaattcaatacatatcttttgaactcttactgtccaaacctggtccccatggaaaggctacttggacgtggacatcggtcctgccttctctttggccactgccaccaactctgtgttacacaggctagaactttaaacagtcctctaagtctcagctggatttattggtggtagctttgtctacaggtgcttgaaatattactgttatggccaggcatggtggctcacgcctgtaatcccagcactttgggaggccaaggcgggtggattgcttgaggccaggagttcaagatcactctggccaacatggtgaaaccccatctctactaaaaatacaaaaattacccgggcatggtggcgcatgcctgtaaccccaatgtaattctcgtggctgagacatgagagtcacttgaacccaggaggcagaggttgcattgagtcatgatcacgccactgcactccagcctgggggacagagcgaaactctgtctcaaaaaagaaaaggaaaaaaaaagaaatattactgttgtaagtattaacagctattcaaattaacacagacttctaatagaggcgggaagagatcacttagatcttccaaagccatgaccccactcaaaactctccccatttcgaatttattctttttcattggaagctaaagtgcactctccttctacaaaaggagattttacaatttttacaaaattgattttacaattctatttttttgtgtgtgccttggttcttacacttgctaggactactaggtttcaagtgtttctctcttttaaggtactcctgaagagtctctctcttatatctattgctgtttaactcatattttctttggtctggggagccaagatcccaagatccacgattccagctgtaggcagcttgggtttttgctttaccatggtgatgtttttataaaagccaaaacagcaattacagtgtcttagaagtggtggatgaattttgcatgttagaaacagtcattgtgccattatgcaaatgaaatgtaattttatggaaatatgtgatgcagagtgaagctgagtggcttaagtacaaatccttatgcttttgtttggttaatgcactttcaaaaatattgttaggttagctggcacagcaagcatctgtagtcccagctactcaggaggctgacgcgggaggatcacttgagcccaggggttcgaggctgcagtgtgctacagttagttgtgcctgtgaatagccaccgcactccatcctgggcaacatagcaaatccctgtttctgaaaaacacattttaaaaattgttaagttgaaattcaggtcattattgtcccttcacaataacagaaatgactgacaatggcaaatgtgattaaaagcatgcactctagagttacctactagcttaaggtccttgggaaaagcaccgaatctctctgccttagtttccccatctgtaaaatggggctaataatagtatcactatcttgggtttttgcaaggattcaatgagttaagatgtgtgaagtgcttagaatagggcctggcatatagttggaactactagtttaaaagtgttagctatcacatgaaaaataatatgattatcttctggaagtcagatacaatttaaggatgcattttataatatggtattacttcttcaatgcttcaaccaacctaattgtgatgaagtccaacagcggcaaatattgatgttgttttgttttacacacttttggtaattgaattactgtaggcattttccctcttggacaggatatgttgatatcagagtcaaggtaagtgtagtaaatagaagcttaggtttttttttgacacctgattggtgagtctgattctgttataatttcttaattcccatgacaagatccactgctctgttttgcttcttgaacagcttgtctggattgtactttctctcttgccgctgtagcgcagccagcccttgcagtgggtatacttttgaaaatctggaccttgattttgcagcttgtctgcacaataaacagccgacccatgccaattttcttccaggcggtctttggcagaggaattatgactggctgctcctcagtgggtggccagaaatttagttaaaatataagaaatccaactgcaaactatttcaatcttttctattgcagaaacggatgccgttataactttgaaaaatccatcatggccacttaatttccctctttacattacattttagacgagtaattcttttgaaatccaaggtcatatgaaccacaggcaaaattctcggcagtgctgaagattctccctgaaaggtctctaggctcggcttaggaactgtgggtgaggaaacaaagaatttccttttggactgttagtctgagctagctcatcattgtccctctttgttggtgctctaaatgtgtcatgatgaaattgcaagacggttcaatgccaaactgcatttagtaatcttcttaatctctttttgatgcttttatagtggctagtggtatctgtggttaagggatgccagacagtttttctttttaaatagccagtctagcatttatctgtctattcatctaccagtccagctcttgaattggaaatgattataggtgatttataagtatatataagatatgacaatgtactatggattaaaaactgagtgacagaggaaggaaacacaatgataagatcataatactaagtcagaatgaaagttaaaatgcaagatcatgtagcgttatatcagcagtttcaaaatttagcaaccgctgtactccccatggggtatttgttaagaatgcaagttccttaaccccaccctcggacccctggcacctatattgttaacccgtgcccccaggtgatcctgatgcaggtggttgtaggaccacactttagaagcactgacctatttccttgctgcagatgggtaaatttggctccaggttttctggcagtcaacatgaaaaatgaaggctaagttttcctagtgtgcaggagataacatccttggcatatggtatcaatgaagatgtaactatgcttatatcaacttgaatagctgaataggattttgacttgtataggaattcagaaaggaaatgtcttctgtagtcctccctaacgtgaactatgtcaatgagtctgtggcagccaactaaacgatattaactaaacttttcttttggtcaggggatgctaaagcctcttagggagaaagaaagagaagaaaaaggaggagaaagatgggaaaatacaaaaaaggcagaggagtgagaaatgaaaaataactatggccacactctgaacagtggtttgctactgtccacaaaaggtaaatacatgcacaccccatgacccggcagttccattcctaagaattcgtgcacattattgccaaaaaacatgaatggaaagttgacagcaacgtggtttacagtagcccaaaactggaaacaacccatcaacagtagaatagtagaatggatacattgttaaatacaatgtaatactaaaaagcaactaaatgaactacagttatgtgtaaaaacacgagtgaattctaaaaacataatgctgatcaaatcagatgggagaaaatacatactgtatgactccatgtatttaaatttcaaggtgagtaagaagagaactgatgtattgtttaggattgcatgctttttaagtttttgagacagagtctcactctgtcacccaggctggagtgtaatggcgtgatcatggctcattgcagcatcagactcctgggctcaagtgatcctcccaccttagcctcccaaagtgttgggattacaagtgtgagccatcatgcctggccaactttttggatttttttttttttaagacagagtcttcctgtattgcccaggctggatttgaactcatgggctcaagtgatcctcctgcctcagcctcctgagtagctgcaattacagatgtgtgccactgcacctggctaaacattttaaagtcaggataaactaattaagttattaaacttttccttgaaatgctgtgttctgtggttacagttttctagaaggactgtaacacttttaagcaaatctgccttagccatctgaagattttattttgcatgaaataaatactaagcatatgtttgttttcctaaagaaatattttccatatattaagataacacatacttattttaaatgataaataatgagaagctgaaaaattaagggacatttaaaagataaaaactgtgagaaaggtagagaaaatcttactggattatactgttagtaatgtcctctcccattcatatggagaaagaatggattaggagacttcttgatactgagtttatgagagaatacatggttgttaccatctcttgcatgtctcctgtatgccatttaccacgatagatacttatgttttgggttttttggtttttgttgttttgtttgtttgtttgtttgtttgagatggagtctcactctgtcacccaggttggagtgcagtggagcaatctctgctcactgcagcctctgcctcccaggttcaagtgattctcctgcctcaccctcccaaggaactgcaggtgcctgccaccacatctggctaatttttgtatttctagtagagacagggttttgctgtgttggccaggctggtcttgaactcctgacctcaagctatccacctgcctcggcctcccaaagtgctggaattacaggtgtgagccaactcacctggctggtactcatgtattttatttgctactatctcaaaaaattcctgagaatgaagaactgttatccccaccgttccctgacctttttccactctttttttttgagacggactcttgctctgtcgctcaggctagagtacagtggtgcgatctcagctcactgcaacctccgcctcccgggttcaagcgattctcctgcctcagcctcctgagtagctgggattacaggcacctgccaccacacctggctaatttttgtatttttagtagagacggggtttcaccatcttggtcacgctggtcttgaactcttgacctcgtgatccacccgccttggcctcccaaagtgctagaatgacaggcatgagccactgcgcccggcctttccattcctcttattcctttctgttcaaattcattcacacaagaagttttgcaaactcatccttcagtatgaaacaagttttactctttcttgtacctcaaatctaatttactttgctctgttgctggtaactgagcagaatagagaaataaatttcaaattaatgaattagatctaaaacccttctattctgtatctgtttccctaccagcttcttttggtaggattttgactaacaaatttggaatcatctgagaaaatcttgaactcatctgtcattgtttttcccccagtagcagctaaagatggaattagtgggcttttgccagaataaacagtctgaatcttcagtgagagctatgaaacctaactcccagtcatttctaaaggatgtgtccacactgagctcctttagttggcctttacaaaaatagcttctgtccattctctaaaactgattcctttcatgatgcattgtttatcccacttaacttagagagggtataaaatttgattcattttggggcttctaatttatgcagaaaactaagaattaccactaatgttttataattgctctgttttaatgcattcatttgactggaagtcatatgaaattttttattcctcattgatgcttagagaaaataaattgcaaggctttcaggatggaaaaagacactagaaaatttaaagtgcacattctaataccccttatgaacaaggattattcaacattaaatatgtagttattatttcaagagagatatgatttgatattttatttcttctgaattgtgtcatttcagagcaggaatggccctggtaaggcatcaagtcaaattccttcattttacagataggagcctttgactcagaagctacatgctgggcagtggcaaagctgggactagaacccagtgctcctctcctcacagagccattcccaaacaacttccacataaaatataattttaaaagcattttagaacctctgtggctgggcgcggtgcctcacgcctataatcctagcactttgggaagctgaagtgggagatcatttgaggtcaggagttggagaccagcctggccaacatggtgaaaccccatctctactaaaaatgcaaaaattagccagaggtggcggcgggtgcctgtaatcccagctacttgggaggttgaggcatgagaattgcttgaatctgggaggcagaggttgcaatgagctgagattgtgccactccagcctgggtgacagactgagactccatttaaaaacaaaaaaacaaaaaaacaaaaaaaacttatattagaatgttgcattataataggtgtgacaccaactggttaaaactggatgtattacctattttctcacctaagataataaaatttcgaccctttcagttttacacccatatgcatatatactcacaaacacacatatatatacctatacacacatttacatatatagctacatatacacctacatacgcacctacatatttacacacatatatacaccttcacaacatatttacctatttatatacatgtaacaaatagatatataaatgcacctacatatatgtttatatgtacacacacacacctgtgtatatattcacctatatgtatacacacatatgttttacacacacacacacacacacacacacacacacacacacagtagaataataaaaaaataaaggctctggagtcaggcggagaatagaacccaactggtactgggtgtgtttccttattatgtaaacttttaaaatctgagtttcaccatttgtaaactgggaaaaaaaataggtaatatatgttaagtggttaacatgttgtctgccatctaataagctttcagtaactatgagtagctaccattgtgaacaacatatacaaaatgtttaacagtgattcaacttgaaaaaagatagatatgattcattgtcttcacctccgtactgatcggaatcaccatgggtaggctggtaggaccatgcctgggatgcctggtggccctctggtttggggactgggcttaagccaaggaaagtggcatagtcttgttaatttggggaaaaaaaaggcactttcaagcagagcgtcagtctcattcctaatcgattgtgaaaggagagacacatctcaggaggctggaaggtgggggatccaggcagcctgttgttgcaggttgaaagtgagcagaagcacctgtattgcatatgttcaggataaataaagacacctacacaggccgtgtgttctgggtgagcagtggccctccagactgactgggagacagctaataggtgagaagatttggccatagtcatccagtgtgttatggtccaaatgctgaggctgaggctagggaatgtggaggaaaaaggagtcagaccaactagaatctggaaaggtcaactggctgacagctgtccatctggggcgacatccagggaccaaggccagaagctcaggatgagtcagaatgggcatggaccgccaaggtgcagggcgtcccagaggctgtacccaggcacgtggacatcaggctccccagacaacccaggcacagggttagggtcaaggccaagaacaaggtagccagaaatgtatccacgatatggcttgaaaacgggagggagcgaagagagtaagtcacaggctgggcgagggcaaggacagattggaaggagggagaaaggtgggctgcttctgcgtcatccgtcctggttgtgtcccaggcctgagagttgatgcatatggcttctgacagaagaaaagatagaagagtgggcagaaaaaggaaagaagggtttgcttttgatggagtggaaacctgaattggccagcagagagagtctgcaggggtttctgtgagggagagaccagtgtaggaggggctttctttctagcctctgctttccctggggacccttcagtgtcatttttccacttctgtcattgacccacttttcttcccacctgtatcagtcagagtgggcgtggttttgctgcagtaacaaatgacccccaaatctcagtggcttataacagcaaacatttatttttggctttaactacatgttcactgtgagttggctacagcttgcttcctcgtaatctttattctgtgaccccagctgactgagtggactctctctctctctggaacattgctgcttgaaatggcagagggaaaagagaccgtggagaaccttgagctggccttggagcacctgcacagaagggaagtgacacatgtcatttccactcacatttcattgaccaaaacaagtcttatggccaagcctgacattaacagggtggcaaaaatctaattcttccccagaaatgagcaatgagtatttgtagcaataatatagtccgccacatgattgcacttgctccagggtcatctcgctactcccacgacctcagtaactgtcgctttgatcctaggttccttcctccagctcagatctctgcaccaaaacccaaacccacaaatccagctgtcaatcaggcagttctccttcaaactgaacatgctcaactgaagtcattttctcttcaacattttgtttctttttgattaatggctcactgtccacctggctattgacacctgggagtcgtctttgactttttgctctccttcatcatcccagatccagctatccatcagaaagtcttcttgattgtattcaataaatgtttctgcttcttttcatctctcctacctctggtaacccaagatacagtatttctcatctggactactttggcaggctcttcaataacttccatgcctccatcttctccctctccaattcactccaccagcgtccagagcgatctttctaatttgcagatctgacagtacacctttctgctgtctcccctgtttaagctcttgcatggattccgattggtctgagaatcaagctgtggaaagctaataagagtctccgtttcccctccagtcttaccttcgccattatcctacccctcccaatggcttacatctcctggccccaccatcctgaacccctgccatctgccctaatgtgccatgttctgtcttacttctagaatatgacagcgctattccttctgaccagagtcttctatattctcttcagctggctaactctaactcacccctcagatctcagcttacacatcacttcccccaggaggccttctctggcccttcctaaactaggtaaggtattcctgtcacatgctcccatgcacataccatgctgtccttcctttactctggcacagatcaccgcttagacgtgcagtggtcctcccttactttacaagaccccagtggaggcctaaaactgacgatagtactgaatcgcataccatatataatatgttttttgctgtacacatacctgtgataaagtctaatttataaatttggcacagtaagagattaagaacaacaataataaaatggaacaattataacaatagattgtaataaaagttatgtgaatgcagtctccctctctgtcgaaatatcctattgtacagtactgcaggtcactaaaacacaaaaagtgaaaccatggataagggggggttaccgcaacataaatgtctgctgtctctctctgttgctgcactggaatctgtttgagggcagtgactacttcaacactgtatctccacctcctagcagagtgcctggaatagtctaggggctattggatggaatgatgatgaatgaccattcatggagttgaaaatttgagttgacatgacctcaaaagcaaggccagaaagacccagaaaggtccttgcttccttcatgtcaggggagctgagaaagagtagcttggattagggctggaggataatataagttgcaaagtacaacagacttctggagaaagataaaggaagggcagggtctgggaagaagtgagatatactagaatagaacctccttgcgagatgggatttttatctgttttgttcactgcagaattcttgggcctaaaacagttctcaacacatagtaagcagctaatactttattgaatgaactaatgagcaagtgaatgaatgaatgaacaaattgtaggtcagggttctttgacttcaaggaccaaccctggcagaaagagaatttattggacatacatagggcagttcacagactctgaaagccagaaaatcaagcctggcaaatgaacagcaaccaagggaagtcaggcagatagaaccacagccaaggttgcatcacaggaataccctgctaagggcaacacgctggcactgctgctgccagacactgctgtccctggcactgtcaccactgccctccttgtgagagtcagctctcactgaccctgtgacttgacattattccttcgagactgagagtcccagacaggaatccctgattgtctgaaccaaggtgggttgcttgctcattacttgccagaaaacgggagagagtgaatatttatcccatcagcagagggggccacgctgccatcttctccctaagaagacggtcgttcaatgctgggtagcctaaaaagcactcttaagtgtctaagcataataaatgcttacgataaaaattcaatcaattcagaagggtgcaaaatacaaaatgtaaatccactctctacttcccaatctctatttcaccccaagaaataaccactggtattagttggtaatgtgttcttacacacttcttcaagaaacttcatgaagtttatatgtaaattacaagctccctataatagctaggaagtccagccctgtgcagtttatgaaacaataagaattgtttcatcaagaaacaataattacataaaaacaataacaattcttattgtttcataaactgctggacttcctagccactatagggtatttgaaagttacatataaaacttgtaatttgaagttttttgcctgggaataaagtggctgcttggagtctgaagcctcggccatgtgtggtgttgctggtggttcctaacgctcaggaggggactacctgcccagtaaactgtaggcagactggctcttggtgctgtttgctttgtgtgttgcattaaatattactgggtatttcttgcttgagattgatcagggatgtaatgacatctaacattgtgatgggtaagcaaaatgtgggttctattggagggaaggtattcactccgcctttgccctaattgttttaaattgctgaggggacagtctcctgtttaggatgtctcttgtagagagttctgctcttcttaaagaacaaaaacttactgggtgcagtggtacacacctatagtcccagttacttgagaggtttagatgggagggtcgcttgagatcaggagttcaaatgcagctggggcagcatagtgagaccccatgtctaaaaaaaaattatatgtacgtacctataagaggaaacaaaagttatctgaaataatatttttctgggattttaaagaaataaggttctagaactaacccatcctcaactgattgccaggaaacctagttctgggtgtaatattcttcattgtgttggtaaatgtgtgacttttagtgcccaggaagcagtgcctaggtgcgccacagtggttggacagtgcaaacataagacactttgataggagacagttttgcacaaagaacagagaatggttgttcaaataagcgatttgaatttttttcattttattttattttatgtttttattattataccttaagttctagggtacatgtgcacaaagtgcaggtttgttacatatgtatacatgtgccatgttggtgtgctgcacccattaactcgtcatttacattaggtatatctcctaatgctatgcctccctcctcccccaaccccatgacaggtgtgtgatgttccccttcctgtgtccaagtgttctcattgttcaattcccacctatgagtgagaacaagcggtgtttggttttctgttcttgcgatagtttgctgagaatgatggtttccagcttcatccatgtccctacaaaggacatgaactcatccttttgtatggctgcatagtattccatggtgtatatgggccacactttcttaatccagtctatcattgatggacatctgggttggttccaagtctttgctattgtgaatagtgccgcaataaacatacgtgtgcatgtgtctttatagcagcatgatttatcatcctttgggtatatacccagtaatgggatggctgggtcaaatggtatttctatttctaaatccttgaggaattgccacactgtcttccacaatggttgaactagtttacagtcccaccaacagtgtaaaagtgttcctatttctccacatcctctccagcacctgttgtttcctgactttttaatgattgccattctaaccagtgtgagatgatatctcattgtggttttgatttgcgtttctctgatggccagtgatgatgagcattttctcatgtgtcttttggctgcataaatgtcttcttttgagaagtgtctgttcctatcctttgcccactttttgatagggttgtttttttcttgtaaatttgtttgagttcattgtagattctggatattagccctttgtcagatgagtagattgcaaaaactttctcccattctgtaggttgcctgtttactctgatggtagtttcttttgctgtgcagaagctctttagtttcattagatcccatttgtcaattttggcttctgttgccattgcttttggtgttttagacatgaagtccttgcccatgcctatgtcctgaatggtattgcctaggttttcttagagggtttttatggttttaggtctaagatttaagtctttaacccatcttgaattaatttttgtataaggtataaggaagggatccagtttcagctttctacatatggctagccagttttcccagcaccatttattaaatagggaatcctttccccattgcttgtttttgtcaggtttgtcaaagatcagatggttatagatgcatggtattatttctgagggctctgttctgttccattggactatagctctgttttggtaccagtaccatgctgttttggttactgtagccttgtagtacagtttgaagtcaggtagcatgatgcttccagctttgttcttttggcttaggattgtcttggcaatgcaggctcttttttggttccatatgaactttaaagtagttttttccaattctgtgaagaaagtcattggtagcttaatggggatggcattgaatctataaattaccttgggcagtatggccattttcacaatattgattcttcctatccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtcttttatcggtgtataagaatgcttgtgatttttgcgcattgattttgtatcctgagactttgctgaagttgcttatcagcttaaggagattttgggctgagacgatggggttatctagatatacaatcatgtcatctgcgaacagggacaatttgatttcctcttttcctaattgaataccctttatttctttctcctgcctgattgccctggccagaacttccaacactatgttgaacaagagtggtgagagagggcatccctgtcttgtgccagttttcaaagggaatgcttccagtttttgcccattcagtatgctattggctgtgagtttgtcatagatagctcttattattttgagatacatcccatcaataccgaattcattgagagtttttagcatgaagggctgttgaattttgtcaaaggctttttctgcatctattgaggtaatcatgtggtttttgtctttggttctgtttatatgctggattacgtttattgatttgcataggttgaacaagccttgaatcccagggatgaaccccacttgatcatggtggataagctttttgatgtgcggctgggttcggtttgccagtattttattgaggatttttgcatcgatattcatcagggatattggtttataattctctttttttgttgtgtctctgccaggctttggtatcaagatgatgttggccttaaaaaatgagttagggaggattccctcttttctattgattggaataatttcagaaggaatggtaccagctccttcttatacctctggtagaattcggctgtgaatccatctggtcctggcctttttttggttggtaggctattaattattgcctcaatttcagagcctgttattggtctattcagggattcaacttcttcctggtttagtcttgggagagtgtatgtgtcgaggaatttatccatttcttctagattttctagcttatttgcacagaggtgtttatagtgttctctgatggtagtttgtatttctgtgggatcggtggtgatatcccctctatcattttttattgcatctatttgattcttctctcttttcttctttattagtcttgctagcggtctatcaattttatcgatcttttcaaaaaaccagctgctagattcattgattttttgaagggttttttgtgtctctgtctccctcagttctgttctgatcttagttatttcttgccttctgctagcttttgaatgtatttgctcttgcttctctagttcttttaattgtgatgttagggtgtcaattttagatctttcctgctttctcttgtgggcatttagtgctatacatttccctctacagactgctttgaatgtgtcccagagattctggtatgttgtgtctttgttctcattggtttcaaagaacatctttatttctgccttcatttcgttatgtacccagtagtcattcaggagcaagttgttcagtttccatgtagttgagtagttttgagtgagtttcttaatcctgagttctagtttgattgcactgtggtcagagagacagtttgttataatttctgttcttttacatttgctaaggagtgctttacttccaactatgtggtcaattttggaataagtgcgatgtggtgctgagaagaatgtatattctgttgatttgaggtggagagttctgtagatgtctattaggtccgcttggtgcagagctgagttcaattcctggatatcctttttaactttctgtctcttggatctgtctaatgttgacagtggggtgttaaagtctcccattattattgtgtggggtctaagtctctttgtaagtctctaaggacttgctttatgaatctgggtgctcctgtattggctgcatatatatttaggatagttagctcttcttgttgaattgatccctttaccattatgtaatggccttctttgcctcttttgatctttgttggtttaaagtctgtttaatcagagactaggattgcaacccctgccttttttttgttttccatttgcttgttagatcttcctccatccctttattttgagcctatgtgtgtctctgcatgtaagatgggtctcccgagtacagcacactgatgggtcttgactctttatccagtttgccagtcttttaattggagcatttagcccatttacacttaaggttaatattggtgttttttttgttttttttttaggacggagtcttgctctgtcacccaggctggagtgcagtggcacgatctcggctcactgcaagctctgcctcccaggttcatgccattctcctgcctcagcctcccaagtagctggaactacaggtgcccaccaccacgcctggctaattttttttgtatttttagtagagacggggtttcaccatgttagccaggatggtctcgatctgctgaccttgtgatccacccatcttgcactcccaaagtgctgggattacaggcgtgagccaccgtgcccggctaggttaatattgttatatgtgaatttgatcctgtcattatgatgttagctggttattttgcttgttagttgatgcagtttcttcctagcattgacggtctttacattttggcatgtttttgcagtggctggtaccagttgttcctttccatgtttagtgcttccctcaggagctcttgcaggacaggcctggtggtgacaaaatctgtcagcatttgcttgtctgtaaaggattttatttctccttcacttatgaagcttagtttggctggatatgaaattctgggttgaaaattattttctttaagaatgttgaatattggcccccactctcttctggcttgtggagtttctgccgagagatctgctgttagtctgatgggcttccctttgtgggtaacccgacctttctctctggctgcccttaacattttttccttcatttcaactttggtgaatctgacaattatgtgtcttggagttactcttctcaaggagtatctttgtggcattctctgtatttcctgaatttgaatgttggcctgccttgctaggttggggaagttctcctggataatatcctgcagagtattttccaacttggttccattctccccatcactttccagtacaccaatcagacgtagatttcatcttttcacatagtcccgtatttcttggaggctttattcatttctttttactcttttttctccaaacttctcttcttgcttcatttcattcatttgatcttcaatcactgatatcctttcttccagttaatcgaatcagctacgaagcttgtgcatttgtcacatagttctcatgccatagttttcagctccatcaggtcctttaaggacttctctacactggttattctagttagccattcatctaatcttttttcaaggtttttagcttctttgcgatgggttcaaacttccccctttagctgggagaagtttgattgtctgaagccttcttccctcaactcatcaaagtcattcttcatccacctttgttccattgctggtgaggagctgcattcctttggagggggagaggcactctgatttttggaattttcagcttttctgctctgttttttccccatctttgtggttttatctacctttggtctttaatgatggtgacatatagatggggttttggtgtggatgtcctttctgttcattagttttccttctaacagtcaggaccctcagctgcaggtctgttggagtttgctggaggtccactccagaccttgtttgcctgggtatcagcagcagaggctgcagaacagcgaatattgctaaacagaaaatgttgctgcctgatcgttcctctggaagcttcgtctcagaggggtacccagccatgtgaggtgtcagtctgcccctactggggggtgcctcccagttaggctacttgggggtcagggacccacttgaggaggcagtctgtccgttctcagatctccagctgcctgctgggagaaccactactctcttcaaagctgtcagacagggacatttaaatctgcagaggtttctgctgccttttgttcagctatgccctgcctccagaggtggagtctacagaggcaggcaggcatccttgagctgtggtgggctccacccagttcgagcttcccggccgctttgtttacctactcaagcctcagcaatggcaggctttcctttcccagcctcactgccgccttgcagttcaatctcagactgctgtgctaacaatgagcgagggtccatgggtgtggaaccctttgagccaggtgcgggacataatctcctggtgtgccgtttgctaagacccttggaaaagcgcagtattagggtgggagtgacccgattttccaggggctgtctgttacggcttaccttggctaggaaagggaattccctgatcccttgtgcttcccaggtgaggcgatgcctcgccctgcttcggctcacactcggtgggctgcacccactgtcctgcacccactgtctgacatgccccagtgagatgaacccggtacctcatttggaaatgcagaaatcacccgtcttctgtgtcgttcacgccgggagctgtagactggagctgttcctatttggccatcttgggtcaacaagtcgtgatttgaattttaagaaagcagaactagtggttataaatcttagtagagtccagctctggactggactttttgtaagaaatatatgacaaaccataaggcacagctataaacagaataatgtacttatagaaagttggataaatgcagttcaggttgttacagggctgacccaaatcatcgctcttggtccaagtataaggtctcaagctggtatccaatgtgacctctcaagagcctacaggtaggctgggtgtggtggctcatgcctgtaatctcagcacttcgggaggctgaggcgggcagatcacctgaggtcaggagtttgagaccagcctggccaacatggcaaactccatctctactgaaatcacaaaaaatagctgaacatggtggtgcacacctgtagtcccagctacttgggaggctgaggcaggagaatcacttgaacctgggaggcggaggttgcagtgagccaagatcacaccattgcactccagcctgggcaacagagagagactccacctcaaaaaaaaaaaaaaaaaaaaaaaaaaaaaaaaaaaaaaagcctagaagcaaaagccagcacttcagtccaacctgctttgcccagctctatgtcaaagaaggatgttacttggatgatgttgtatgcttcttctttgccaaacaactgtctgcagtattcatacacagaagtgagcagatcagatatgcttataacatccaggattcccatacaaagcctttctattggaaatcaatgctgtattagtatctaaactggtagcagttctgttttacattcatgaaatgggataaattttaaatctttttgatagaatctaatgaacaaatatgggttaattttaaaaatgtgagttgagataatctagtttaaagtcgcagccaaaatagaagtcagctgtgattcatctgaaactatgtggacattctgagtgctgataacagaggagggccttcctttgaaagtattattttacaaggtgattatagcaaagctacaatgagtatgacagaaagccataatatattttgatacaaagaaacattggctctttaaaagaaggtaccaggaacagaagtaacagttaaaaattggcaaaagcaatgatctttgatattaaatttaattttctcttgccttactgtcttgactgtcatacaaatgaaactcagcagactagaaatgctggaaaaaccatttttctataacaaaattacagttacctaggaggaatgagttctggtctttgcagcactgtggggtgaatatggttaactgtaatttattgtatattttcagaaagctagaagagaggactttgcatgctcccaacacaaagaaatgataaatgtttgaggtgatggatttgctaagtacctgatttggtcgttatacatcatatgcatgcatggaaatatcactccgtctcccataaatatgtacacttattacatatgtagaattataacactaaaagggaagaaacagtatcgtgtgaatctattaaaataatgcccttgttttgtctgagcaggaagtcaataattttttcatgttccaaagagaagctagatcatgacctgggccttgaagggtcaacagtggcccagggaaaaggactgtgggcatgacctgcaggaagaggaagccgggctgtgaaaccacagggaggagaagtggagttgtggtggcagcagggactggggctgtctggagaaggcatgagaaagtgggagttgcggcagtgtcgattgtagttgtccttctgcctacatgccatgagacatatcttctcctgggctatgccaaatttcaggactgcctcaggactcctttccttggtatttacccaagagaaaggaaaatgcatgtccacatcgtcttgtacactaaggttcctagccgctttttatgtaatagccaaaaatggaaaacaatctagaagctgaaaacagcctacatgtctggcaacaggtggtaaatggcatgcgactcaacaataaaaagggatggacggatgatgaacatagcactggggaagatctcaaagtcattatgctgagcaaaacaacgcagacatctcccttacccgcactccccaagtaaagagtacatgctacataattctgtttattcatttatttatgtgtttatttatttttgagacagagtcttgctctgtcgcccaggctggagtatagtagtgccactgctgctcactgcaacctccacttcctgggttcaagcgattctcctgcctcagcctcctgaatagctgggactacaggcgtgcgccaccatgccaggctaatttttgtatttttagtagaaatggactttcactatgttggccaggctgatctcaaactcctgacctcaagtgatccacctgcttcggtctcccaaagtgctgagattacaggcatgagccaccatgcccggcctatttatgttttattttttagagacagggtctctcactctgtcatccaggctggagtatagtcgtgcgatcatagctcactgcagcctcgacctcctgggctcaagcaatcctcctgtcccaacctccccaggttacaccaggtgagcaccactgcacttcattaattaaaaaaattttgtttgtggaggcagggtctcactatgttgcccaggcataatacatacttctgtttctataaaactatagaagacgcaaactaatgtttagtcaagcaaacagatcagtggttgtttggagacaaagtagagggaaggatggattacaaagtggcacaagaattttgggggtgacgggaagtgtttggtaaattgtgttttagtttcacagacatgttcatatgtcaaaacacaagtggacagttcattgtaaaaaaaaaaaagttaaaacaaaggtagtacccccaaataaaagaacagggcctgctagatggtaagttctcaataaatgtcagttaacgataataataataggtaggtactacgattattcctagttaacaaagtggaaactgaagccaagaggttaagtaacttgcccaaggtcacctagtcagctggtggtgtgtccaggatgcagtcaaactgcaagacctgaaccccatggtaggaaaaagagtgtgaagacagggctagaagaacgggcaggtccagaaagaagattataagaggcaccatgtcagaggagcagcaaggcggactggagggcagtgggtgtgtgaagaagagcttccactgagaacattctatgggcattttgtatcaagtacaggaacttgccttttctcactcagtcattaattcacataccataaaattcacccatttgaggctgggcgtggtggctcacgcctgttaattccagccctatgggaggccaaggtgggtggatcactggaggcaagaggttgagaccagcctggccaacatggtgaaaccttgtctctactgaaaatacgaaaatttgctgagcgtggtggcgcatgcctgtaatcccagctactccacaggctgaggcaggagaatttcttgaacctgggaggtgggggttgcagtgagccgagatctcacccactgcactccagcctgggcaacagagcaagactctgtctcaaaaaaaaaaaaaaattacccatttgaagtatacagttcagtgggttttagtatattcacagggttgtgcaaccatcaccacaggttaatttcagtgtttttggcactcccccaaaaaacctgtacgtatcagctgtcaccccccgtcttcctcccttacttcttcagccgtaaccacagatctacttttcatcactatagacttgcatattctgaacatttcacatgaatagaatcatgtaatatgtggtctcttctgcctgacatctttcacttagtataatgttttcaaggttcatcatgttgtagcatatatcagtaactcatttccttttatggatgaataatactctattgtatggatataccgcattttgtttatccaatcgtcagttgatggccatgggttgctttcagtttttggctattttgaacaacgctgctattctcaatcagttttatttcaacaactaatggttatttcaactggtaaagagagaggcatatatcaatcacaggcacagatacgatctgagtagacggctatttatttgcagatcatctggttcattttgtatttaacaaaatatgtggagacttttttgacatatttttctgtgcagtaaagaacttagacttaggttacaggtatcaatgatagtgctgcctaattacttgtgtttaggaaaattgtttgcaaaggaattgataacttttattgagtgcttcctattaggttgatgtattttttccagtataattcttacactattctgtgtgctcagttttaatacccttaatataaatgagacttctgaggcacatggatgttgtagcacgtactgcggtgcctgcctccaagttcacccacaggtgcgtactggcagcttctcattttaaccaccagtctctctgcttctcagcctgaggctttctcagactgtctgaaaatcccttagcagtgctagggatctaatcactccagggcaaccctaaactgttgaagtgactacatgctcagctttccttcttccttccagacgttctacatgagaggtcagcaaacttttgctcttaggaccagaaagtaaatattttcaactctgtaggccatacagtctatgtagcaactattcaactctgccattttagcatgaaagtaacaatagacggtaccaaaagaatgggcttggctatgttccaataaaactttatttataaatagacattgtgtgggttggatttgacctgctgactgtagtttgctgacgcctattctccatgatttcttagaagattcctaacggagttgaaccccagttgcaccgagaggtaacccattcgttaccatacccttttttactggcctttctttcttccctgtgtctttatttacatgcctatatttttgcttcctggggtctccaaccagacaaactccctgtcccaaattccttctctcaggatctgtttttgggggaaccaaattgacaaaccaggacaatacgatattacaccaggctgagaatatgcatatgaagagatcagaggctgtggcgtgagtctgaggcgcagttctgcacctgaatgaccctgggcaaataacttcacctctttgtgcctcattttcctcatctgtaaaatgggtattgtcacagaacctactgaaaaaagttgttaggaggattttatgtgttaatttgtgtaaaacagaagcatgcctgataatagaggatttcttattataagccatagagacttgtgaatggttcataaagtttttcattcatttatggaaagaccctttatgccgtctttgcaaaaaaaaaataggattgagttaatggatttttcaaaaaattcttaagacttcatttttttagagtagttttaggttcacagcaaaattgagaagaggctacagatatagccacctgccccctcccctcccgccccctacatgcacagcctcccccaatagcaacattccccaccagagtggtccatttgttacaattgatgaaccaacattgacacattattctcacccaaaattcatagtttacattaggactcattcttggtgttgtaaatcctgtgaattggacaaatgtacaatgacatgtagtcacttttttttttttttttgagacggagtttcgctcttgttgcccaggctggagtgcagtggtgtgatctcgactcactgaaacccccacctcccaggttcaagcgattctcctgcctcagcctcccaagtagctgggattacaggcacttgccgccatgcccagctaatttttatatttcttttttagtagagacagggtttcaccatgttggccaagctggtctcgaactcctgacctcaggtgatccaccctcctcggcctcccaccaatgctgggattacaggtgtgagccactgcgcctggcctattcaccattttaaattatttattgtgagaaatataaatagctgaacaatacaatgtacttttccccagtttggccttgatgatttgaaaatatattgtcctttgtgttcaaaaaacacaaagaattcctgtctttgggcgctatttactgtatactgaaatatttatgaatgaaatagcatatcagggattgtttttaaaaatgatcgtgggaagagaagtgggtgtggatactgaaataagattggtcccgagctgacactggttgaaattgggtgatggaacctgggagttcattagaatattctctctactttcctatttgacattttccataaatataggtggttaaaaaaatacatggcctcagaatctataaacaaaactttgctgctataagaactgcattataagaaggaaggaggggaattatctccagctacatcctggggaccaccaccctaatttgttaacatatcagaactacaggctcttttttattcttgtgcccaagactctccgcgagatttatcttctgtggtcacagcaggggaaggaaccttgtgacactctgctagggaagaggagaggcggtgacactcagccaagttagggaagtggactttcgatatttgaaaaggccattcaaaacaacatttgaaagaagtcagagtatttgttcagtgaaacacttaggatctataaaatggttatagtgtttgtccaggagaataaacactgaaaatctgtagaggggtcacagcctttgcccagaggagtaaatcattcagatacaatttttagctattacaatactgacatggagttcaggtgataatgggtatgtacttttaccatgtccctccctgtgactgtacaaacctacatactgacacctatgtgttctcagactatgtataagcctttccctgtattacagtgctcatcatcactgtaggggacctttgaaagagctgccggagaaggtgaggaagaaagccctgcctggaaagcaacagtgaaccaccagtgtcagcaacgtgaagcttgctgcaaggcctgcagtcatgatgaacccagcagcttctagttcatcccagtggccctgagactatttatcctgtgacttcacacgcgcttggaagttttgttgtgatcttcgctgagtctgtgcggaaatcacaggctagattttagattttttacttttcagcatgtgacttaaagttctgttgacttggggaaagggctgataatcttgtgctaaatcactgatggaatataaattaaaatctccatctctcagtcaatccaagtgtccatcaatggtagactggataaagaaaatgtggtacatacacaccatggaatactatgcagccataaaaagaaacgagatcacgtcctttctaggaacatggatggagctggaaaccattatcctcagcaaactaacaaaggaagagaaaaccaaacaccacatgttctcatttataagtgggagctgaacaatgagaacacgtggacacagggaggagaacaacacacactggggcctgtcacggggcggggtgaggggagggagagcattaggaaaaacagctaatacatgctaggcttgatatctaggcgatgggttggtaggtgcagcaaaccaccatggcacacatttacctatgtaacaaacctgcacatcctgcacatgtaccctgaaacttagaaataaaaatttttcaaaagggaaaaataaaatgtccatctcttgaatcctggttttttacttatcccacatggccctgtcgtttgcacagattatgtgatggttttgagttgatgggggctgcagaaaaattgtgctaatttacagtgaaaatcaaatcaagacatttgattgatgatgtgtgatcaaaattgtgcacggctagatgtgctgattgatgacgtggttttggatatgccgtgtattgtctcagctgcaggtaattggaatccatatgcattagctccattcctctcccactgtggcatgcagacattttgcattcggagccagtaatttggtgccttttccgacaagtttggaatgaaagcatgaatgctaaattttggaataccacagtgtgatatgaaaagcatattactaattaatggaatagaaccaggtaggaatttcttggacagataagagagaaatggtgtttttaatctggaggtgatcctgagtaattcttctgagctcagtttttaactgacaaatcttaatatcagactttattaaaaacgttttcaaagtggcatgtgcaattaaagcttcatcaaggagaggcactgcatgtcattactggtaatagaatcctgctcctgtagtttttaattcccacttttctgaaatgaaacacaaccagttatgtagtataatatgtaaaatctactagggaattcaataattttgcaattaagcttgaggtattttaaaatcattttgtctattaaatatgtcactataactgtttaatcatgacttgaataagagacaggagaaagcatatctgggaaaatgcaaatggttgatgagtagaagaattgactaaggttgatgtgtagaatagtggtaaattctacagaaccttagagctccttcaagggagggataaacatgagccacgcctgggagacagtttgtatattttgagaagattggatggttactgtggttagcttggtatgtggccagggacagcagaaaataaggatgagttcagctaaaagtaatagaatgcctaatttatagtggcttgtatcgtcatttctcattttgacatccttaacaacattgccagggagcccgttattaatgtagattatcaggctccacttcagccctgcaaaatcaacattcccattgtaaggagatttccaagcgattcataggcccattaaactctggtctagaaaacagagatacttagatatctcacagaataaggataggaatgcaagcagttccagagtggctggatctaaatcaccaataacaggcttttgtctcattccactttgcaatccctagcatgttgactttggccttttgttgtgtggcctcaggattccaagatggctgctgtggctcctcgcaccagtgcattctaggtaggagaggaggggcagacgtcttctaatatctcattggccagacgtgggtcacatgttgacttttttttctcttttaacctttcctatggtactgaacatgttgacttttagatgactcacttgggaagataaaaggattaacattactaatttatacattcattcattcagtaaaaaaaaaaaaaaaattgcctactatgtgccaactcatgagcattccatggggctacagctgagatcaaaggtctacgtctattgtctgaacaaaattagggttattttagtgaagaggaaatgggagaatcattattaggtagaattaatatcagtcacaggtaggttgaggccagatttggaagggtcttggaagtcatgtcaagaatggacggagaccagtgaggatacctttgaggtgattcaagttagagatgatgaggaccggcctaggataatagtggctgcgatggaggaagggatgctttgaaggtcggctctgaggcggaagtgcctacttagtgatactgtatgtgggcgatgaagaggcggggtgattcactgaaactctgatgggatccctcactcagctgtctcagaacagctgacatgaaaaaaaaaaaatctatgtatcatatgactcttagcagtggattttttttttttttgaaacagtctttttttttttttttgagacggagtctctctctgtcgtccaggctggagtgcagtggcgtgatccgatcttggctcacttagcagtagatttttttaaaacctatgtatttaacacatacataatcaggtgatacaaagctctgtaatctagattttccacctgatgtgtcatgtaccgatttctgtcagtacatgtagaactatctcatctttctttaactcactttttatttttatttgaaaaatgttgtaaaacacaagttaaaaaccatgtataatctaataaatttaagaaactataaaaagtaaaaaaagaaatcaccccttcattttacttctggagcatgtatctctcccagtttttttccaaaggtagcgcagacttaatgagagattcccatgaactgcacatacatacctctctatgtgtatacagttgtccctcagtgtatgtggggatgagggcattggttttaccacccctgtggataccaaaatccatggatgctcaaacccccgatataaaatgacatagtatttgcctgtaacctgtgcccaccctcctatatactttaaatcatctctagattacttatactactcaatacagtgtaaatgctacatacatagtgttatactgttttgttcagggaatagttataagaaaaaatgtctgtacatgttcagtacagacacaaccatcctttgttttttccaaatatttacaatccacggttggttgaatccacagatgcgaaacccatgggtaaagagggtcaactgtatataaattacaatgtgttacaatgtgcagtttccactgtgactcttttttacaaaaatttctgccctttgttatgagcacctgtggtccaagaataagcagtgtttaagagagctttacctcaaagtttacacttttcatttttctattatgcatatagattataatacatattgtcagggctggccgtggtgtctcacgcctgtaattccagcactttgggaggctaaggtgggaggattgcttgagtctaggagtttgagaccagcctgggcaacatagtgagaccttgtctctatttaaaaaataaaaaataaatatcttcccccaaaatacatataatctgcttcaaataaactttttttttttttttgaaacaacgtctctgtcactcaggctggagtaccggtgtcgtgatctaggcttactgcaacatctgcctcccaggttcaagccatcctcccacctcagccttctgagtagctggaatgacaaccggctaatttttgtattttttgtagagatgggagcgggggttctccctgtgttgcccaggctggtctcgaactcctggacttcaagcgatcacccatctcagcctcccaaagtgttgagactacaggcatgagccaccacacccggcttaatgaacttctaatacactatgccatttaaaaatttgtttcattcgttgtctgactctcttttcactaggatgtaagtttcccgagggcaggggttttggtttgttttgctcacagatgtgttgccacagactagacagtacctggcccccagtaggtgctcaatacatattgaatgtgaagtgaataaacttccagcagactatcctcattgtgctttaacacatttaaaatgaccaaatggcttttccctgtacttccattctgtgtcttttccccttgacctcatgtgatatgctcagggacgccaactaatgttagtattaacttaagaaaagtggagtgtagccgggcacagtggctcacacctctaatcccagcactttgggagaccgagatgggcagatcacttgaggtcaggagttcaagaccagcctggccaacacagtgaaaccccatgtctactaaaaattagccaggtgtggtggagcacacctgtagtcccagttacttgggaggctgaggcacgagaatcacttgaacccaggaggtggaagatgaagtgagcagagatcgcgccaccgcactccagcctgggcaacagagcaagactccgtctcaaaagaaaaaaaaaaaaaagaagggagtgtagaaatgaatttcccccaaagaagccactgatgcatgccacggtgaaacttaaagaattactcctatccggtctttgggattatctgcaccatggcctccctccccttacaggaaggatcaagctgaccacataaacatttagactccctacgtgagatgggagaacataagcccctcatgagtttgtataatactcatggccacagttacacaatgtggcagacgtatctcttcctttccaaaagaaggaaagagacaaatgtatgatacctgatatgacacatgttttcattcttcacaatcattaaagtaataaataacactactttttagagacaaggaatttatctgttgacaggaatatgtattgctgggcacagtggctcatgcctgtaatcctaacactttgggaagccaaggcaggaggatatcttgagcccaggagttcaagaccagcctgagcaacacagcaggacccctctctacaaaacataaaaagattacctgggcatgggggtgcgtgcctgtagtcctaggtactcaggaggctgaggcaggaggattgcctgagcctaagagttcgaggctacagtgagctatgatcacagcctcagcaacagagcaaggtcctatctcttaaaataataaaaataaaaacaaataaataaataatatagaaagagaagagagttgagattccaaaacagtctttctgactccaaactccatttttatcctacaccactttttcataaaagttcagaacagattgtttgatgtttttcttattgctcattattactttttaaaaggtcaattctgacatgtgatttacatttcctgacaaactacatatcattttcctccctcccttctgtctttccttccttttattcttccatttataatgcaacagatgatagtttttcatggtgtcctgtaggtagtgtattttattttaaaataccagataaaattatcagcagccacttgtggaaagcttcactggaaaatattacttcaaccatacttatatgttttttaaaatgctatttttgttgatctctgcttagaacaacagaaacacagatggctacagttactggatttgctgccagtttttatgccccttttctcatatacgtttatggcgaccaagtttactttcaaaaacatatgctaagaatagtaacacatttttcagatttgaagttgtctaggaaaaaagtatgcttcatattaagaaagagtctgtaagatcaacaaagcagattcatctcctagaaaacccattctctgagcaggccattttcatctctaaccaataaacaccagattccttagcttggcaatcaagaaccttgaccatatctggtcccagatgattcttcatattttttatttttgttccaagatggtgtactctattttccagcaaaatgggacagttaatttttcctcgtagccatgctttcctctgttttgttcattgttgtttcttttgcctggggagatttcctcttcttttacttaagcattccgtctctcctagctccttctcttacttaagcattccatctctcctagctcaaatgccacctcctccagaaagtgttcctggattagatttgctttcacacctctagacctcctttatttgtcccttctttaggacacatatatgacatcttttactttaattatttctgccccaattcagagtactattagaaggctgttaataaaaaatgaatgtgtcggaagagttgaaagaagttgtttaataataattcctgctaatggtataatgagacaggattacagacaggtggcctgcaaactttattgtaaaagttgcctaccatagtgtttgaagaaaaacaattcaattggaatgcctgcagattggcacacacactctaccccaccagtctccccgttccccattgtcttccactggcacatcatatatttacattccctcactgactctgggtggcacttgaatttacaagctccatatagaggttacatcaatcagttgatataccaggtccaagtcatggctctgtcactttctagctagctgtgtcaggttaagagcaagacttctaatgatacctttgaatggccctttgtatttgaggtggccttatgcaaataaacaggcacagttgacccttgaacaatgtgagggttaggggcgccaatcacctgcatagtcgaaaatccacctataacctttgactcccaaaaagcttaaccgatagtcttccgttgacctcaccaataacacagtcgactaacatatatttcgtatgttttatgcactatatcctgtattctcacaataaagtaagctgaagaaaatgttattaagaaaaatcataaggaagagaacatattgcattattcattaagtagaaatagatcatcatacaggtcttcaccctcattgtcttcacgttgaataggctgaggaggaggaggaagaggaggggttggtcttgcagtctcagaggtggcagccgcagaagaaaatctgagaacaagtggatccatgcgactcaatcctgtattgttcaagactcaactgtatatttttgcatatgggctcaaatacgtacgcacatatgtcactgggtcaaagattcatagaatgaattagacaacaagaatatttatcattgaattgaaatggctcactgcaaaagtgccctcaacttatctctaggccttagaaacagaagtgaccctttgctgctgtgaatcaatagcctggactagattggggttgggttggcaaaggtatatagtcattgccatagtccagtattcctgcccaagcaagcaccattagtagtcacgttgctcagagagggcctctcggctctccccaccactgcatgctggattgtctgccaccagtagatcagagttggcaaaagggataactcgggatgaaacatttgagcattttgcagtttagagaaacttcaggggtgctgctttagtaaaaaatggaagacttgcatttattaaaggttagtaagaagtgaaataatgtatgcaaaagtacattataaattagaaaatgcaataacggcagaaactatttatttattggttgctctgccctttacctaagtggtttttgaccatttaacaatgtgtaagagttgggttttacctccattttatggatgtggaaatagggcttggatgttagctaacttgcccaaatcttacagctaacagaaagtggtactcccgagattcctacccaggtttgtctgacctcaggcctgtgctctttatatgagttcatgctaactctcagatgatgtgctaggcacaaaaattagatattacaccaatttccactatagttaacattctatctaaatataaagtgggaccacggtcttagatgaatgtggctgttgagagcggcaataatccagaatggctactctgatctacgttgataaggaaattggagaaccaggcacccgtgtggctgccaaggatgtgctgaagctggagtctagaccttcaatcaaagcattagatgggatatctcaagttttaacacgacgttttggcaaaacatacgatgctccatcagccttacctaaagctaccagaaaggctttgggcactgtcaacagagctacagaaaagtcagtaaagaccaatggacccagaaaacaaaaacagccaagcttttctgccaaaaagatgaccgagaagactgttaaaacaaaaagttctgttcctgcctcagatgacgcctatccagaaatagaaaaattctttcccttcaatcttctagactttgagagttttgacctgcctgaagagcgccagattgcacacctccccttgagtggagtgcctctcatgatccttgatgaggagggagagcttgaaaagctgtttcagctgggccccccttcacctgtgaaaatgccctctccaccatgggaatgcaatctgtttgcagtctccttcaagcattctgtcgaccctggatgttgaattgccagctgtttgctatgacatagatatttaaatttcttagtgctttggagtttgtgtgtacttgtattaataaagcattatttgtttaacaacataataaatacataaatataaagtgggtcatattcctctttatgtgcatctgtctcagctgtcccttgtttctatatttcttccatactacagcccgtactctttggggatatgtcaacatgatttacttctgtagagaaacaggagacaggaaatagcaaaggataaaggagaaaaggccagggccaggccaagaacttctacatcttttcttcccagcctagtgtgaaccagatgaaagccttaaggaggtcctagcagcaaagggagataattaaaagaatgagaattttgtggaatgctaaaaaaaaatagggaacatatttgcagctaggactaacactgattatcttaaaatgtctatatggctaaataatgttcatgaaatcccgtatcttattctgctaatgtcttacaacttaaagcacttttatgtccatgccttgaattctgtacaaagctttgatagagtcacagatgtctggtgtcaatccagatcacctgagaggcttcagggtttcctctctggttcctgaattccaagacttagtgagtttcctaggccaggagctgctattcattatacatgttagtggttttgctctttctactgaaagtgagtggtggttatgtctctgaacatgttattccacaaaaagccaactagatgtggctatttaagaaccatcaaaggccatgacaggccaaagtttccaaatccctcttcaatcaaaggatgctgtcagaactgacctccaaaaaagatgcaaggtctcagtcctaggctgtcatactggtccttagagaagagttacaattttgtgatctgctccactccattttgatttttgcttccatgctattttaaaactggagaaggtttaagtttaaaaattcaagacaaatcataaaatatttgagaatttacttgtacattgcctgtcttcccaaataaactgtgggccccatgagggcagggaccatctctgttttgttcactatggtgtccaagtacttcccccatatcttggagctgattctgtggtgggctgctccaagtaatctttatcttgggccagtagccacgcaggtcaaggataagtttccattaggtgtgggcataagctcctacccagccattgtcctcttcaccagaagaactaaatttcatctgtaaaggaagacatcacattctgtaaatggtagggcctcattctcctgtaagattcatatttctgcattttggattcaagaaccataggtgtatcccatggcaagacaggaagtattactggagtcagactccctgggtcttaaccctgcttcctctgtttaatggatatgcaaccttgggcaagccggtaacatctaaaattttactcttatagctgttgatagagacactaaacgtttaaatttctaaatgtttactgccatatttatgtatggttattagcatagtaaggatctaaatgatatcagagtagaaactcaataaatatttgttagatggatgaataattaacctctcagacttcagtttcatcacctgtaaataaagaggtttagctatatggtatctttgcagttctaatatcctgtggacttagttatgttagtagttatgatattttttattcttggtaattttttcaggattactataaggataataagaagtcaaattctaaactgaaataagtcaagggaattgaataaaaacttggataaaaaaagaaagtgttttaaaaatcaccctaagtccaatgatcagctggcctttgatttaaagtgtgtctgtggtcagcccacggaaatagtatacagcttctctgaagctctttaacatcttcattacagtcagtttaagtacttctttggcaataaacatcaactttttttcagatgtctctttgcatatgatggccttggcatgagacatgaaaccattaagaaaatacaagccaggtcctctgctacagtccataaaaatcatttagttgaagctatgcatatttacttattagcttacactcatttttaaactgactcacaaaaagtacagtattaggccattcttgcatcgctataaagaaatacctgagactgggtaatttataaagaaaagaggtttaattggctcacagttctgcaggctgtacaggaggcatggcagtggcatctgctcagcttctggggaggcctcacaaagcttccagtcatggcggaaggccaaggagggagcaggcctctcacatggcagagcaagagcaagaaagagttgaggtggggggtgagggaggggggaggtccaggtgggcggaccactggaggccaggagttcgaaaccagcctggccaacatggtaaaaccccatctctactaaaaatacaaaaattagccgggcatggtggcacatgcctgtaaccccagctactcactgaggaggctgaggcacaagaatcgcttcagcccaggaggtgaaggttgcggtgagccgagatcacgccactgcactccagcttgggtgacacagtgagattccgtgtcaaaaaaatacccatttatgtacttacgtacaaaatatctgaaactgctaagactgggtagtaattacatgggtgtctcttatattatgctatttaaatgttttaaaaacatttaataatttttaagatcctaagaaacaagaatactgtaataaaaaaatccaatatcggactctactcccttgtagattaggaatgatatccctgctctttttccccccaatggctcatttgtacttggcatttggtgcctgcttaaaacaccagggtgactacagggtccctgatgttggttaggggccctctctgtagctttcatagcaccctctcttttccttctcactgcatttatcacccagttgtgccatttcctgtttccttgctgtatgggcctgctggaccataagacgttcctgcaggggcaggtggcttgcttactatagcatccctgaggactggaatgcaatagatattgagtggctgaatgaattactgcaatggtgactgcaatggcttaagttcagtgctctgcacacacatgggccagggttggatatgcgaaattaccacttgatgaaattagttaaagcagcatttgttggcacagagaggccgtgtgcccctttcttggagtcccctaggcttcagtgcatgcaccacagtctcacagttggaaaggagggtcggggcgctgtacttcatgtaaggtgattctaaacctcgtgctagatccactgacacatccaactcgagactcaggatccaactggacactcaggttcccattaggctgtggcgaggaccaagcccgctgccactgaatttcctaggcactgaggtcagggttttcctgtccactagcctgaccagtttttcacagaaaggaccaatgtgcctgccttcccgagatccggcagcacagctcctgctttgtcctgggttcagatggagtttggcctgttggtcccagcgtagcctggatggggacaaggggcagcctactgcgggtctcactttcttattagcccctggcctggctgaacccttgagaagggccctgctgcctcagacccaacaagaatttgcttcctttctctcttccttccttcctacctcattcgttcatttgttctttagaatctgctgccatttcatgtctatttgtatctcatctagctagcatcagctctgtccccagcctcatgaaaaaggccaagctccttccctgacagagcctgctattggcaggaagctgccagagcatggtgtctgtctagagaacctctcttggccatgccagctccctgaaatcttagagcatgaagccctgtgtttgtagcagttaggacctgcttggagggatgctgacaggtggtctacgcagacactgctccactgtgcctaggtgaggcctttggtgaattattttactttcctgaacctcagtttcctcatctgcaaaacagaataagtaataccttgcagcagggttttaacataattaggggctgtgaagtaaagtggttaagttggcagagtgcctgggcctgattctggttttctcctttcccacctgagtgcttcagtttccccatccaaaaataggtactcatactctcgacctcatgcgctgtaaatgctttgaaccatgcctggtgcatggtggatgctgcctgaaggtttgctggttttagcagtgtctggcagataggaagcactcaatacacattatgttttattactattacaattattcttaccatctagggttgggagatagataatatatgaaaacatctggcatgcagtaagtactcagcggatattgttttcatccttcctgacccttgatcttggagcaggggtaccttgaagtggagggaggtgatccctgcactgagttggcattcttttttatacttgtgttgtccctgagaacaagaactctagatatttggaaaagttccaggagcatcggggctcttgtgatattatgacctagagatcggtgagcagatatgtttagttctaccttgaccctgagcgaaggctgccaggtgcaaacctgtcatggacatttatttatttatttatttattttatttatttatctgagatggagtctcactctgtcaccaaggctggagtacagtggcacaatttcggctcactacaacctccacctcccagattcaagcgattctcctgcctcagcctcccgagtagctggtattacaggtgccaccatgcccagctaatttttgtatttttagtagagatgggcttttaccatgttggccaggctggtcttgaactcctgacctcgagtgattcacctacttcaccctctgaaagtgctgggattacaggtgtgagccatcgcccctggccatgggcatttaatttagcgtatatttcacaacatgcctgagggaagcttggaagggaccttggagatcgtgggcctaatacccacaatttacaaggtggaaacaggttcagagaatgtgacatgaactgtctgaggtcacatagctggttgccagcaggtataggctagcagcaagcacctggacagcctgggctgcctcacacagagaaagactccacaaatccatgtgcaaattgattgacccactttagatgactcctgaccctcatctgaaagctgaatttatcttcacctcacccagagcaaaacttctgtcctgtttggaaaattccaggttagaagagcaatgactcagacatcactacttagaagcgtttaaaaaactgagtgggatccccacacaaatggaaaagagaagctaaactatttccttcttatattttctcagcccttacatctcctatcaaggccaatggacattttcaattatgtaccttctctagctacgcatagagactaagatgcagatggtggtttattttataatctatgagtttctttgctaagtatacagacaccttttatctttttttaattattatactttaagttctaggatacatgtacgaaacgtgcaggtttgatacatagggtttgctgcacccatcaactcatcatttacattagctatttctcctaatgctatccctcctccagccccctaccccccaacaggccccggtgtgtgatgttccctgccctggagacaccttttatctaaaggttttcagaggggcatttgcctaggaattcggcacttgggtcttatattctggaagatgagcttgctcagtgcacctgaagattacactgagttttaccaggcacattcttcttgttgacatgcaagtacctgtggcttggtggactttttgtaggaatcttaagttacaacaaaggaaaaaattcaaattgttttgtgcatttctgcagaggtttgtggcaccatttttttttccaggtgcttgctgtgcaattcgaatccaaaattcagtgctgaagcacataaatttaggctttgaaaagagtgaggacattcacaaagagcttcatttgtgtttaaaacttggcaattttaaaggaattttattaagataaaaaagagggccgggcacagtggctcacatctgtaatccctgcactttgggagggcgaggcgggtggatcacctggggtcaggagttcaagaccagcctgggcaacatggtgaaaccccgtctctactaaaaatacaaaaattagctgggcgcagtggcgtgtgcctgtaatcccagttacttgggaggctgaggcaggagaatcgcttgagcctgggaggcggaggttgcagtgagccgagactgcgccattgcactccagcctgggtgacagagtgagactctgtctcaaaaaaaaaaaaaagataaaaaagagaaattattttagaagtgggaaattatcctaaatgaaggtaaactaaaccaccttataaaaaacagaaaattttgatttactatagaagaagtggaaagaggaagtttgggtcagatttttattcactaatagatttgatcaggaaataggagttgattcttttcagtcttatttttgaaggagaaatataactttcagtttagaaaaaaaagttatttcttgataaaattagtgctctgtcgagtgatgcttctaatgtttccactatgaattatagcaaaatgtctgagtttaaagctaagagtctatgttgagttacaggatggggtgtgggtgtcgaaatcttgactctaaatttttacagtgttttcttttatgagctcaggactgctgggtttttccatgaatttgaaacaagcgcacagtgttttgaaaagaagattatttgcttaaactttatagactgagctaaaaatagaaaaacaccgattctatttttggaatgtcttacaagctaaaaagtaaacatgattgctgttcgtattgaacaacatactgagaacagatgtttaaatagcaaaatgtaataatttagctggttttgaaatatcacagcattttaatgaattgattgctaatgaagagatagacctatgtcataagtaaatttctgtttcagcaagtgttacttacaaggagaaaaaaaggcatccccaagctggtatgaactttactctcaaagggctttgttactatcttcttgtctcctctggagttgcaagttcaggggttcccttttaccctgcagtcttcttagtatttctggtgggactgcagccagctattaattttgcaaggcttttggatacatttaatgaaggtggctggggccgctaaaaatgttctcatgaagtcggcttgctgttattctggctaacaagaaactacaatgtaacgcagaaaatcaaaacataaaattagagaccttgattcaaatgttgacatggatatatcaaggtagaatgttcttgaggtacccacctgaatttataaggtactcctcaataagtcctcacctaatttgttcttctacttctcctctacattttctttccttcatgaaccaatttattgagcaccgtttgctctgaagacggtcttcaaatactccgtcttgtcacctgaagattcatcttgaatccggcatgatttaaaatgtgagtgtgggtgtgtccttgagagaaagtgagccatgtagacaggcaaggagggattggaggtgtggggttgggagagggagtgtgagttccatgtgtgagtgagcaggacccaagcctggggacgaatttctaaactgttgaaagtgtggcgggcaagtgatgcttgtgtgtaccaagtctctgcccagctagtatgataggaatgtaccagagacacttggacgatttgtggcttggcttatggagttaaagtaacaattggagcacagtcttgctgttagacacagcaactcataaaaagggagaggaaaatatcaagacacatcctgcaggcccaccatgctggagtgaattttggctcacacacaatcccttctctgatcttaactgtgtgtcctgtcctattttgtgtgtctataaacccagctctgagcttgaggcctccagcccatcatttgttttacttctacatttaagacatatcattcacactataattccaatatcaatcattgttgctactactaatactattactaccaccactacatctacagccaaaatttgctgtgcatctactataggccagtgctttatctgtgtttttgtttgtttgtttgagacagagttccgctcttgtcgcccagtctggagtgcaatggcacaatctcggctcatggcaacctccacctcctgggttcaagtgattttcctgcctcagcctctggagtagctgagattacaggcatccactaccaccatgcctggctaatttttgtatttttggtggagatggggtttcaccacgttggccaggctggccttgaactcttgacctcgggtgatccactgcctcagcctcccaaaaagtgctgggattacaggcatgagtcaccacacccagccaaaactatcccttttaagtgtgggatccattattacaaaggcccagtgacttaacttacctaaagtcattcaatcatcatcacacagcgggatttaccaaaattaagatgtaatttacattctgtaacattttggtatttagtaaatccacaaattttggtatttagtatattaatgtaaccatcatcaccatctaattccaaaacattgtcatcactgcaaaaagaaaccctgcacccattagcagtctctccctattttctcctctctccagcccccggtaactactagtctattttctgtctctatggatttgcctgttctggatatttcatataaatagaatcatacagtatgcagtcttttgtaactggcttatttcaattggcatagtgctttcaaggtccatcagtgctgtggcatgtatcagtacttcattactttttatagccaaataatattccattgtgtggatataccatatcttgttgatccattcatcagttgaagggcagctgggttgtttccactcttgggagttgtgctgctgtgcacattcatggacacatttttacatgggcatatatgttttcaatttatgcagagggatttttagtattagattttcaggatttggtattatccttggcaaatatgggtttctttggaaacaaatttttctgtttgtaagagatgattgcatatcatcaaacttacactaacattccctctccactatgaagctctgatttctgtcctatctcctcctatgcaaggcctgatttccagagaacgttaatcttctaagcctttctccatgcggatccttcttcctggaaagcccattccctctccaccttctgtaaatggcctgaaaccagccaggaagctgggttttcctttgcagcctgaagttattttccttcctctgggaactcatcgaagcttcacctggactttgagggaaaataacttcaggcttttgtcactcttttccctgcctgagcttccctgctaccctctatgccccttgagggcaggattctggtctgactccattttgctatttcctgcaaggacttctgtggctttccaaaataggtgctaatgaatattcatatttgtgaactgaattcctgatccattgccaagtggttctgattcacttgaaacccagttgaacttccttgtagagtttgtattacaatggctctatttttaaccaggtcttagggtggggaggagcaagctggcagagtgaggtcattcttttgcatgtgtccctgcctcactggccccccccactagagggcagcctgcctggcatcacctcctaaacttacaggaggttttgccgcccttgcttcttgttcctcctcaaaagaagaaattggcagaagagctggggcaggagtgtcagggtttgttttggtggggatatggtcaggcttagtagggaagcaactcttccagttcccagaccggcccccctgcctttcaagtcctccgttaatgtctcaggagtgctgagatggtgagacattaaagcatccttttaaagttacttagacaacaatttgagatttctgtagggatactgtattagtctattcttatgctgttaataaagacatacctaagactgggtaattataaaggaaagcggtttattgactcacaattccacgtggctggggaggcctcaaaatcatggtagaaggcaagaaggagcaagtcacatcttacacggcaacagacaggagaagaattgagagccgaacaaaaagggttttgccttataaaaccatcagatctcatgagactcattcactaccatgagaacaggatgagggaaatcacccccatgattcagttatctcccactgtgtccctcccacaactcatgggaattatgggagctacaattcaagatgagatttgggtggggacacagccaaaccatatcagatactatcgtgtttagatctctgcagtcctatttggatagcctattgctttccacagagcaactatatatatatattttaaagtaaaggatctaaaactgtaagagtggttcttgatcctggctgataatcagaatcacttgctagaatatatttctaagctttaagtaaacccagagtcaacattatgggtcaacaccaataatgacctctgtggctgaattcagtgggctgacacatttgacttggctaggtggagtgttttaataattgagaatgcattctctaagatgctgtagttacttcattctttatcctctcacaccttgccctcttcacacatttatatgacctgcttgctctttgaggtctctgagaatttgacctttgctccaaaacagcccaatcatctgagaccctctactctctctctcacttggccaccttcccattacaggtgactctgatagacaatcagggctggaaactatcagtgtctttgagcaatgactattctgtctgcagaggttctcaattctgactgcatgagagaaacaccttggagatgttaaaaattactgatgcctggctgggtgcggtggttcatgcctgtcatctcgcactttgggaggctgaggcgggtggatcacctgaggtagggagtttgagagtagcctgaccaacatggagaagccctgtctctactaaaaatacaaaattagccaggtgtgacagtgcatgcctataatctcaactactcaggaggctgaggcatgagaatcacttgaacccaggaggcggaggttgtggttagctgagatcgtgccattgcactccagcctgggcaacaaaagggaaacgccgtttcaaaaaaaaaaaaaaaaaaagattactgatgcccagtatacgtacaatcctttcagggtagcatatgcagttccttgtgggaaggatatatttttcagatgggtgggagagtagtattttacagaaaatagtgtatttgaataggccaggcgcagtggctcatgcctgtaatcccagcactttgggaagccgaggcgggcgggtcacctgaggtcaggagttcgagaccagcctcaacatggagaaaccccgtctctactaaaaatacaaaattagccgtgcgtggtggtgcatgcctgtaatcccagctactcaggaggctgaggcagaagaattgtttgaacctgggaggcggaggttgcagtgagctgagatcgcaccactgcactccagcctgggcaacaagagcgaaactccatctccaaaaaaaaaaaaaaaaaagaaaatagtgtatttgagtataggattagattttctgatgttaagtttccttttgatggaattccagattataacagaaaatgtctttgtgcagtgtgactggcaagctacatgctggtagtgaattaaaataagagctgtcacgtatatttcttaaaatatttggtgttagagcaccacacattgctatcaaatctacccaattcaaaggctcctcctactttcccatgagattagtgattctgcctactcctggattaggaaggaagacttggatcagagaaagacccctgtgtgcctaaaagataacacaaaccttagacaaattctaacccagactgcaggagcctctaccctggatgtgtatatactgagaattggatccaggtttaaacaatgaacccttcatgtccttatttcacctgcctgcatacgttcccgctgttaactgttacattgaggatttggcctgtttttttgcaagaaatgcagtttttattcccctaaacctaatgtaattttcactttttggcatctctattttctgtggtggaaaatttatcttagtcataggtacttcagatttccttagtcaattctgggttctcctcatcctttccccagaattgcttctaagttctgggcatttttggagagtttcgtgtaggagttggagtgatggagtatgatgacatttgtcctgggttcagcttgtccagtctggtcctcagctgaccatccactcacatcaaaactatgttgttgcctgataactctctaggtcgctctctagctgaactggttcataccagcccaagaacacaggacagttttggctgctttctccagggcctattggtcagtaccttttaatcattaacgttttaagaccaatgttaatgaatctcatctactagtgcttctcaaactttaatgagtataccagtcacctggaattttggtaaaatgaaggttatgatgcagtaggtctagattagggcagggcctgagattctgcatttctaaccaacagccagttgctgctgaggctgctggtctgtggaccacaccttgaatagtaaggttgtagagtctacaagcattctcgctctaatggaactgtcagcctccatctcttctaagtgtttgggaaagtgatgtggtaacagggaaagatttggctaaatggctgcaaatgcactcccttttccaccttcattaagcagggaatatcactgcttaaaagtgagagaatagtacttccctaggatgcgtctaaggcccttttcaagggtggcctctgttggaatgatgtcactttttttttgagacagggtcttgtgctgtcacccaggctggagtgcagtggctgaatctcaactcactgcagtttcgacatctagggctcaaatgatcttcccacctcagcctcctgagtagctaagactacaggtgtgtgccactatgtccagctaatttatttttatttttcctttatgtagacatggggtctcaccgtgttgcccaggctggtctcgaactcctgagctcaagtgatcctcccatcttggcatcccaaagtgctgggattacaggcatgagccaccatgcatggcctgatattactcttgactttctccatgctgttttttttgagacagagtctcactctgtcccccaggctggagtgcagtggcatgatctcagctcactgcaacgtaggcctcccgggttccagtgattctcctgtctcagcctcctgagtagctgggattacaggcgcatgccatcacgcctggctaattttttgtatttttagtagagacgaggtttcgccatggtggccagggtggtcttgaactcctgaccccaggtgatctacctgccttggcctcccaaagtgctgggattacaggcatgagccaccacgcccagcctctctatgcctttacggttttatctattcctatgcaccagataaaaccacaagggtggaaaaaagatgaaaccctatcatcccctgtagggtctagccccacagggttggtgggttttttccccgtgtgcagagacgagagagtgtagaaataaagacataagacaaaaagataaaagaaaagacagctgggcccgtggtaccactaccaccaagatgtggagaccggtagtggtcccgaatgccaggctgtgctgatatttattggatataagacaaaggggcagggtaaggagtgtgagccatctccaatgataggtaaggtcacatgggtcacgtgtccactggacagggggcccttccctgcctggcagccgaggcagagagagagagaagagaaagagagagacagcttacaacattatttctgctatcagagacttttagtactttcactaatttgctactactatctaaaaggcagaaccaggtgtacaggatggaacgtgaaggcagactaagagcgtgaccactgaagcacagcatcacagggagatggttaggcctctggataactgcgggcaggcctgacatcagtcaggccgtccacaagaggtggagtagtagagtcttctctaaactcccccggggaaagggagactcccattcccggtctgctaagtagcgggtgttttttgttgacactaacactaccgctagaccacagtccacttggcaacaggcgtcttcccagatgctggtgttaccgctagaccaaggagccctcctggtggccctgtccgggcataacagaaggctcgcactcttgtcttctggtcacttctcactatgtcccctcagctcctatctctgtatggcctggtttttcctaggttatgattgtagagcgaggattattataatattggaataaagaataattgctacaaactaatgattaatgatattcatatataatcatatctaagatctatatctagtataactattcttattttatatattttattatactggaacagctcgtgccctgggtctcttgccttggcagctgggtggcttgccgcccacaatcccccatgatcctctccttttgatattcatgtccttatattatctcctccccttaagtgtggactagacttatgtctttggtttttcacaaacagtaatagagcaaaagtgttgggatgtcacatcttaattcataaaacactgtttttggatttgtgcattctcttggatcacttgtgctgggggatacaaactgccattttctgatcagtgctatggaaagaaacagcaagaaacagaggccctgagtccagcagcttgcgaggaactaaatacgggcaacacctatgtgaatgagcatggaagtggatccttcagtcccaggccagtcttgagatgactccagcctcagttaacagcttggctgaaattttagggcgactttcagccagagccatccagctaagatgctcctggatttctgacccacagaagttgtttgtggttttaagcttctcagttttggggtaactttttatacagcaataggtagctaataccctcactaaactcagatgccagatatttagggaacaacattaaaatgtcccaatggtccttcaagaagataatgcacaattagtagaaggaaaagagaagcagaattcttgggctgggttggccatttggcctgaggaactcagtgagtggttccacctgacacatgcataacacatcagcgattaaacctttggacttttttttttttcaacgtggaactcaggagtggctgggattgaaactcagctttacctttgtagccataaactgaccaccttgtctcatcatcttgccttgggagagaagaaaactatggtgaaatcaacatttctcaagttgctaaagcctcctggcaggcaggagctaaatggttctttttcctctgccccacttttggtctcaatggccgagtttcctgactccaagaaaaccacctttgattatataaaggtattaggggctggggaacactggtcttttgttactagcaatctaaagcgcttaggaagaaaagccctgggggtgggggtcacccctggaaagttgggcgggctttgtgttagctccaactctggggcttttgtggaacctcggagagggaggaattcttagatttctgaaagttgtgcgaaacggaccccagaggcctggaaaggcgcgtccccagcctccagggtttcctgcgcagccctgggcatctcggaagggggcgaccccagcatgtcccaacttcccgccagcagcggagcgcgggggtgggcggggtcggctgcgcgccctcccctcctctcccctcctccccccgcccaccccctccccgcgctctcccctcccacttccctttctctgcctggccgccccgcgggcgcgacctctcggggcagtgacgaactgggtggagcccgccgccgccgccgccgccgccggggagagcgatgccccggccccgccgctccccaagcccgcccccggccgcccgcgggcccacgggccggcggcgggagtgagcgggagccggcgggcgaagagccgccgcccggcccgcgatgtcaccattgttcagctgggtggccaaggtaggcggcgtcgggcgggcgcccgttaccggagcggagcggcaggcgcggggctggaacatttgtaaccttcgggccggggctgggccgggccgctggaggccaggcgcggcggggggcgagcggcgggcgcgaccaggtcgttagccgcgcgtttctcattcattagtctcccagatccctgtggggaggacgggcgaggtagcggcgcccatttcacagttggggagactgaggctgtactcggggacccctgcgggagcccgaacccagcaggcggctcctccggcccctgtcgctccccgcgccgcggagctgccgctcggtgcctccccggcgcgggacctcgcggaagtcgaccccgcgtgtctccctcgcgggtgtcgccctcgtgtgtctccctcgcagaagtcggcttgcgctgggccgcctggacagggcgccgaggatgcccagaggctggtgcccacaaggggcgtctgtctttcgtttttaaccctctggtttcaaagggcatgttctgaggtctgagttttaaatagaagtttttaactttccattcccacaaagttttattttcagaacatcagcgccttcgagataactgggtggtgcaaatccaggccagttgcactgttgctaacaggaaggcataagtgtagatttcccgagttcccaccagttcgagaacacagtaatagcatcaatagcattctttttatccactcctgcagtgccaggtgtctgaatgtgttttaaaggatgcgaccctcgccaccttgaaaggctcgctggtcgttagggcatcttgctgtcaccccatgcactcagtcccttggccggcgccttcccagggcttgtttcctgtgtatggctggttgagtaataagctcacaactcgttagccatactgtgaggctttaccaattaataatttaattaggtggtggttatgtcttgagttatcatgcaatgcttttatagtcttatttaattacatttttatgaatacctgtttgtgagcaggtatggctttgcctgtgatttaagtgatacaaaattggagacacagaaactagataacactagtttttagatgggcaaaagtttttaggtagattttcttactaggtaaataacattccattagaatcacttcctgaaacatagctggtggtaaaatgagatgactttcaaaaacgttttgagtcattaaaaagtcatttcaaaaaccatcacagacttttaggacgattgttagccttctccgagtgtcagtacgttggaaaagtttatatagaggaaatgtaggctggtagcttaatttggattctgaatcttgttatttcaaaattattatttttgagacagagtcttactcttgtcacctaggctggagtgcagtggtgcgatctcagttcactgcaacccccacctaccaggttcaagcgattcttgtgtctcagcctccccagtagctgggattacagctgtgcgccaccactcccagctaatttttgtattttcagtagagatggggttttgtcatattggcccggcaggtctcgaactcctgggctgaagtaatgcccccaccttggcctcccaaagtgctggggttacagatgtgagccaccacacccgccctcaaaattattatttcgattacaggacaacagcggaaaaactattaaatgtttttggagcaaattcatgtatacctcttagcatacatttttaaaatgtggttattttatatttcatttcctgtaggtggtgcatgcattacaaattatatcccgaaattgaatgatttttatagataacgtgttatcctgtgaaagattttagaatacgaaattagtctttggaagtttatttcttggagttatagattgtaagaatgatgttctatggaactgatgtggtttacggtgaagaggcaagtcattaacacactttacattacaaactaggtaatatcctaaagacaaagacaaaaggcatagataatgtacacaatgtgaataatcttgaagttgttatatttgacttcagaatgccccttcagaaacacacagctgcacatgagcacaggcctcacacaaacacctgcacatccagttacgcagctgactttccttttcctttttcattttgacctttgcaactgcagctgaacacctggtggggaaggagaaggggtgggtgtcggttgattcacatggatacctgagcacgaatgtgtttttctttttttttgttttgagacagagcttcgctcttgttgtccaggctggagtgcaatggcacaatcttggctcactgcaacctctggctcctgggttcaagtgattctcctgcctcagcctcccgagtagctgggattacaggcttgcgccaccacccccgctaattttgtatttttaaatagagacagggtttctccatgttggtcaggctggtcttgaagtcccgacctcaggtgatccacctgcctcggcctcccaaagtgctgggattacaggtgtgagccaccgcccccggccaagcatgaatgtgtttttcttgcacgatgcattagtattgtgtgaatattgaatgtgtagagtgggcaatttcatgatgtaggaataaagccaaaacgggagagttttgttttaaagagattatctgtttaaagaagaaagaaaaacataagatgtacttttaaaaaaaattggacatgatctggaacattagggcaggtgtacattgcatcaagaatgtggctgggctttatagcagtgtgatttcttgattagtctttcagtggggacacttgactttttacgcagtttataaataaaactgaacttctcaagctttgtgattttcatagtaaactcacagatgtccccaacaacctgtcagttttgagtatatctactgtttctatgcctccatgtatctgttagtcaaaactgactgcagcagaactgccaagtaacttccagaatttatttggatttgcacctgcttataaagtttgtagctaagattattgctggtatctcaagttggtagattttaaatatacatatgtcagtttatgagaaaaaatggaaaatgagaactaaatatagccaagtttgctgtgtttcaaatccaagtatagtttcatatagtttatggtgtgtattaagtatttaccttatgaataaagtacttaactgtgtatttaatgtattaattaaggcatttaactgtgtattttccagtgctcattcaacaagtgttttattaggtactttttgtatataagcagtgtttatgtcctggaggagttaattcactctgcacaatagattatcctttaaaaagtgtgcaccctggagatttgtaaattaaatatttaaagatgcattaaaaaaggaatcttttttttttttgaccctgagtctcactctgtcgcccaggctggtgtgcagtggcacgatctcggctcactgcaacctctgcctcctgggttcaagtgctcctcccacctcagcctccctagtagctgggactacaggcatacaccaccatgcccagctaatttttgtatttttagtagagacagggtttcaccaggttggccaggccggtcttgaactcctgacctcaagtgatctgcccacctccgcctcccaaagtgttgggattacaggtgtgagccattgcatccagcccacagaatccttttgtaaagcaagtaactgattgctaattaatattttatgtaaaaccaggttttccgtatttgggcattacttttaaaacattggtttatctagccaccattcattcaacaggtcatttaacaaatgtgttcagtgcagatatttatggataacctacctataataggtactatttgaggagctggggatttagcaaccgacaagcagacccctgttttcatggaattctagatgggagagatagcaaagcagcaagcaaataggtgaacaagattatttcagatggtgatcagtgcgaggaagagaagtaagtggctccgggctggggtggtgcaggggtggcattccatctgactggtgagagggcaggaaacatgctccaggcaggcctcagggagaagggaggtatggctggaatatatccagctgggtgcacagcactgagctttgagtggggaggggtaaggtgggccaggctgtttatggctccataggcttagaatggggtttggatttgcttttaagtgtagtcagaagccgttaaagatgtggaaaagaggagtgatgtcagctgatgtatatttcggatggaagcagagggaccacttaggaggtggttttggttcggataggaggtgatagtggtagcttggacctcagtaataagaaaggaataccagtggatagtcattgtctgtattttgaaatgatgtgacccagtggctttgctatcttgtttgtctgtgtttggtgcaaataaccgagtaactaattgctatttatatgttgagtacgagtacaacttgcccttccatcatctctttcttctaagcacagcttccatgcaaagttctgtcctgactctgggcttatttatttacctttgaggtttcctgcagactagaccagcccaccttgggtgccggtaggcggtaggagttgcccttctgtttaccagcacacagcacagcagccttcctatgtaaggtgtgaatctgactatagcaaatatttaggcaacaattttcttgtgttgcttgaagtcagtccagtgttggtttgtccttgatgtgtgtcctaggttaatgtgatgtattgttttaaaatttttttttcttctgtagactcatactacattttattagtggatgcttgagtttaataaggaggggagaactccttgtcatagtcaaaccattccttgaatttgaaaaatgtgctgcctcggctaagcaaagctggtataaccctgaccaggatttcagcagagttcctgtggagcactttttatctggtagtggtggcagctgtgttttgggctttgggaactctagttgcttagagtgtgccaggaacttgggcgtaggttggttttactgaaagagaatggaggagagcagagatagaaatcccacctaatccacaaatagaacacagcccagagcaatgcctgatgagaaaaaaagataaagtataatttgtttccttagacaaattctttaatctgattttaacctgtatgtgtgtcccctgttcttctgtttctatcaaaactctcctcatccttcattcctttcctgaagcacctctgattaatcattcattcattgacgaatgtactaagcagggcagagaataacgggaagggcaggttgtgccaggcagttagagtagcgtatgctaaggcctggaggccccttggtggagctgcactcacaggaggttggtgggcctggagcgagactgctggggggagtagcagaggcgaatgaggaccaggatgagcatggcatacagacccctttggtattttattctggagcagtgaagacccattaggggccaaagatgatctttccccaaactcttttttttttttttttttttcagacggagtctcgctctgtcaccaggctggagtgcagtggtgcgatctcggctccctccacctcccaggttcaagtgattctcctgcctcagctcccgagtagctgggattacaggcaggtgccaccacacccagctaatttttgtatttttagtagagacggggtttcaccatgttggccaggatggtctcgatctcctgacctcgtgatctacctgcctcggcctcccaaagtgctgggattataggcgtgagccactgtgtccgccatccctcccccaaactcttatagctgtgtatttcattctgtatgatgctttgtacggtcaccacactgtgcccagctttttcttcttcccttttttctttaaatatactttattttttagagcagttgtaggtttacagcaaaattgagtggaagttacagagatttcccatatagcccctgtccccactgaacttctcaagctttgtgattttcatagtaaactcacagatgttttgatagaaacagaagaacaggggacacatgcacagcatcccctgttattaatattcctcaccagaatggtgcatttgttacaactgatgaatctatattgacatatgattatcacacaaagtccatcgtttacattagggttcactgttggtgatatacattctacaggtttggacaaatgtataatgacgtatatccagcattataatatcatacagagtagtttcattgccctaccagtcctctgtgatcgattcatccctcccttcctataagcctttggcaacccactaatcttcatactatttatagagcatgtatatatagttctgcctatagagaatgtcatgtagttggaatcatacagtatatatgtagccttttcggattggcttctttcactaagtatatgcatttaagtttcctgtgtgcttttttttttaaaatggcttgatcatttttttgtgctgaatcatattaattgcctggatgtaccacagtttatccattcacccacagaaggacatcttggttgcttccaagttttagcaattatgagtaaagctactataaacatctctgtgtaggtttttgtgtggatatgagttttcagctcctttgagtagatatcaagaagtatgattgatagattgtaatgtaagattatgtttgtttttgtgagaagcactcaactgcttttcaaagtgcctataccattttgtattgccatcaacaatgaatgagaatttcttttgctcctcacaggcatttgatgttgtattctggaatttgattattctaataggtgtgtagtggtacctcatagatgttttaatttatgtttctttaatgacagctgatgtagtcctactccctttcttttgattgacttttaaggaatagaaataatgttaggccaggagtgttagctcacacctgtgatcccagcactttgggaggctgaggtgggtggatcacttgaggccaggagtttgagaccagcctggccaacatggcaaaaccctatctctagaaaaatacaaaaattagctgggtgtggtggcgtgtacctgtaatcccagctacttgggaggctgaggcacgagaattccttgagcctgggaggcagaggttgtagtgagccaagattgtgccactgcacttagcctgggtgacagagtgagaccctgtctcaaaaaaaaaaaaaagaaaatgttagtgcttttgaattttattttagaatgcacagtaatattcacgaacatctgtacaacctataggaagacctttatttggttatatttatgatatatatattttcttgagatggagtcttgctctgtcacccaggctggagtgcagtggcgtgatctcggctcactgcaacctctgcctgccgggttcaagcaattctcttgcctcagcctcccgagtagttgagactacaggcacgcgccaccatgcctggctaatttttttgtatttttagtagagacggggtttcaccatgctggccaggatggtcttaagctcctatccttgtgatccgcctgcctcagcctcccaaagtgctgggattacaggcgtgagccaccgcgcccagcctatatttatgatatttatgaatctaatcttaagtatctggtttttccattttaaaatttctatgatttctgattttgttgttggaagagtggtgaacaagtactctgtgctcttttgttaaatttatatgaaaaagctgacagaaaaattaccttaattttcatgcactttggttattttcctgtaaatcatttttatatctgtcatgttataatgggattagactcacaggctctgttcttttacattggttgaacttggctaagttaactttgctgagcctgttttcttgtgtctgaaatgaacttaatatatacttgttttgtatttatctttttaaaaatagttcctattttaaaatccattaatgtcaaaatctgcttaggaaattgtgaagactatcttcagatgtaaaccatttaaaacatggtcgaatgggcagtttaagttaatggcatgtgtggtattaggcagggtagatactgagatgagtaggacatgggcccagcccttgaatagcttgcagtctaatggggagagggagacctgtggagataatttaattttaatgtgatatatgcacgaagaatcactcagctgggattttggaggagactagaagatgaggtctgagtgaagtcaagggtaattgtaggtcattgatgtggtggattatgaaaaggaatagtgaggaaatactactggtagttttctagcatgtttcagaatgattcaaggttgctttccaactgtttgccttgtttttgagaccactgatttttaaccttggggaaggcacatcagtataaataaattactcagaccttttctttcataccagcactgcctatggccctcaaatacctatcagtaattgtggcttagggtggtggtcattctagtaggatttagtaatgtaattacggtgtaaccagaatgtcatcttgaatgtaattccatttgttcttttctacatggggaactgacacccagagcgatgaagtaacttgatttgaacaagatcacacagctagtttatggcagaacttaaaaagttcttggacacctgtttttgaggtacattgttaatattgctctgctgatttgtttgcactttcatcttcaaactgttttactaaaatcaaaactatgcacatctatcaaacaatatattgtatttcagaatactttatttatttatttatgtttttgagacggagtcttgctctgttgcccaggctggattgcagtggcgcgatctcggctcactgcaacctctgccttccggggtcaagtgattctcctgcctcagcctccagagtagctgggactacaggtgcccgccaccgtgcctggctaatttttgtatttttactagagatggggtttcgccatgttggccaggttggtcttgaactcctgacctcaagtgatctgcctgcctcaagtgattacaggtgcgagccactgtgcctgacccaggatactttatttaaccccttgatgagtgtattcttgcaaatttcaggtcaagatgcctgcagggaaatgagcaaggagaggaagcctgagtagtcgggttggggtgggtggggatcctttgatatgtgaagggtgtctctgcagcctggtaggaccaaccagttgtgttaactgtgcaagaagaagcacagcctgagtatttgaagagagtgcaagttgccaatgtctaatgtggctgtttagctccctagcactgggctgcagtgacccacccattcactgagtgctcctgtttcccggaaggcatcctctgggagatggggtaggtgtgtgtaatggatctcttccctctaatatgagagattgactttgctcagaaaaacatcgactgcaaatggcatttaatagaagggacaattattttagcatgaataacaagggaagagatgattatatttttcagaactttatatgtgccagccattgtgttagaagtctcataattaatttaattctcaaaataattgtggcagtagtggtattatttcctccttccacttttttttttttcaggaaagaaatatgaagaaactgaaattcagaaaggctaggtaccgtgtcctagctaataagattaaagcttgacttgtttggctctaaattcatattttatctgttgtacctgcattgtctctgtaacggggattacaacgcatgttcaatatgtgaaacaagggcagcagagcttagaaaaatatcttgttccactgagaaactgaacttttttcccctttcttaggtgagagacataaaacattcaactaatctgcttttaaaaatagatataccatatggaaactatataagaagtgtaacatttttttaaatccctgaattttgtgatgttctcagttagggagagaaggaaacaggaaataagagaaaaatcacatagaagattgaaggtgaagattgggaggaggttaagacaattcaatgatagaccgaaagaggtcagttttgagtgaccacatgagattgcattttctcgttgacttgagttgtggattttagagtgttttcacttattctctgatattcttttcaaagtaccacagaaccatgtttcatagttattcagcttacctggaaagttctctttaggagtcgattctgcatagactctccagagcatcatactgtggatgttttatcggcctatagatagcacactaggcaggcagtagcaggcgtggggtgcaggtcccagtgtgctctgtgtttgctgtttagccttggctaggcgacagtgggaaagatgatcaatgccaggtgcccatcaggtagccttgtttggcatcacgtgagctgatgtaagtgcatgtaaaccgtcaagcactcttttggatgaacttgtctaggaacagcagggtgtagcacgtgtttccaatacattttttgacctagggcaagttacacttgcctgggcctcagtccttgatctataaaatgagaacattgtgttaaatgattgctacagttgtattcaattcagaatctgtgtccctgtgagtgcaagtcaagccaactatcttagattgtctacctttgataaggaggaaagggcccctgaaatcattggtctaggtcagatctctccaccagttaccagtggagggatgaccttaagtaagttatttttttctctagacattaatgtgttcatccattaaaggggggatgataaacagctatcctctaagcggttgacgatttatccacataacacacttagtacctagattaagcacttagtactcgtgaaccatcatcatcattgaatttaggggtggaggaagacttttgtagttgcttagctgcattccctctttttaaggatgaagaaacatgaagcccactataggtgagatgtctttcccaaagccacagctaagatccaaacagagctctttgcatcacctggcactcattcaaatggaaaccaaaaacaaaatttgaagcaccccaactgaccgatggaccgccccctcctcagtcaagggcattccagagaaacctgaaaaactcgttcaggtcgtgatgggaaaggggacatgcttcattacaccttcctctctctggaattcaggcacaactgaccagcgtaaacattaaaacagagatcttaagactgccaaaacagatctcaaattccagcctaactgcagtctgacatcacttgacatagcaggccctgaaagaaattgaagtattttaccacaaaatatatttctttggcatattttgaaatggccctggaaagctgtctcttatggggaaaatctactttctctaaagaatcctcttcactttccagatcttttccttgaaccaggagagaattaactaagagtctggcacattttttgttaggtctgataagatctctgaagcctgctacctggaggcctcatctgcatgataaaaaccttggtcttcacccaggttatgaccttgtcttaacctacacacttatttctattgattccagatctttagataataacgctttcaactaattgccactcagaaaatatttgaatccacctatgacttgcaacctcccctccaccttcaagttgtcccacctttccagaccaaaccaatgtacaccttacatatattgattgatgtcttatgtctccctaaaatgtataaagcaagctatagccccgaccaccttgagcacgtgttctcaggacctcctggggttgtgtcatgggtcgtggtcctcacatctggctcagaataaatctctttaaatgttttacggagattgattctttttgctgacactaatatttagattctttctgttgttctagcacattctgcatgaattaaacataaaccctgttccctagtacagaacaagagcaaactgctttctttaggccacaagtaacttagatcagttaaggggaaaatgggggagagaggaggacattggcttctgccaccagcagcctgtgtgaccttgcccaaggtcacaactctgtggggttagttccccttccctgaaataggtgtagggagggactccttgacagtttctggtttttttcgtctctcagagtgcaatgaagaatttcttcatggctaaggctgttagactccagaaaatagtttgccaaccaaagacacagagtttccaattttggaatactttaaaaataggaaggaagtttatttgtttagcagaatttataattgtaggactgcccaaggcagagaattagccaagtggtattttgcggaagttctttttaaagggtgggcccaaaggaaaccagtcattaggtggaaataaactgtcagatttttgagacgttatttgcttagggacatttacactggtctattgtgacagtctctattgtgttaggcttttaaaagaaatatgtaagtttccaagtttaaaatgttagagcaagtgtccagtccacggcctgtgggctacatacaggccaggatggttttgaatgtggcccaaaaaagattcatcaactttcttaaaacattgagttttttttttttaagctaatcaactatcattagtgttaatgtattttatgtgtgggccaagacaattcttccagtgtggcccagggaagccaaaagattggatacccctgtattagaacttgtaaaatttgacttcagaaacacaaccaaaagcccgcttatgagtaaggagtttgtggccccttgtgtactgattattaatcaattaattgtataataagcatgaaatattgctagtacatctaaggccaaagccttcttacggttccagaaaaagctgtattcctgaatttccaggtgaagggaagggattctccttccatttccagaaatatgtgaatataatacatagggatttttatcacactagtgtttcagtaaaagcagcccttcaagtctgtgccatccagttttggtgtaactgaaagaacatcgtaccaaagtttgatttttgtcaattctctagtgtgttaatcagctgagaatgtggtctctggatatttttccccaaggaaagagctggatgtactagaccaccagaccacacaactctgtatttgttttgcaataactacactatttgggggagtagtgtggtgtttccagacgttcttggtcaagaaatctggccgcttcaagctcagtgttgatcacaatctatttcttttgcctctactctgtggcaggcacttgagacacaactgccaagatgagagagacccagctgctgacctggggcgggggtgggtggggggaaggtggtgaaggcagtcacagagtcagcctgccagaaagcaggtggggaactgtaaacctctgagtagccccttggtatacagaggtaataatttcccaaatgtagtaaatcccactttacaacctcacggttaattttgatcagggataagtagaactgactatacactgttaacttagatattgtccttctcaaaaacatcatttttattctgggtgccagagatttggcttgggtgtgggtgttaagaacagtccacagtgtcctggagtacctctccgctgatctgggggctctttaaacctctctaacaagtttttgtgctaatcctgactgagtagatggaggcagtggagcccagctggcctgtcactatggggcagagggtgactctaccctcaagccctgcatgaagaccccagggtgggcaccacagccctttacagtcacttagcacctgctgctgaacacgagcatgcagacctggtaaggcttgtgagtttcagagaattcctgcaagtccctggaaatgtgggcactggcagctcttctctctcttttttttttttaaatttagtgggcttagaggttttagcctaataaggaaattttacactggacgattttatcccaaataaaagcaaatcatagggacccagtgttgcctaaaaaaccagtccttactggggaggtctagttgtgtctagcctggctctgtgaccagatgccagccattccagcctcctgtggctgcatttcatcccgaaagtgaataaggtgagtgagtgattcaaaggtcccatccagggggtgacaaagaatattccaggtggaagaaactgcatgagcaaaggtatggaggtggaaacccaaatgaacagaggcttaggaggtgtgttcgaaacatgtttggtacaaacggaacttacagagaaagaagccaggtgaaataaggcaggaagagttgagtggagccccattggtgggagaccctgagggttagcaggactgtgtttgttctggtagggattgcagaggagccctagaaggtttgtgagcaggaggctgaccccatcagacctgtgtttccagaagatcaggctgtgctggatagcaggatggatgtagggagatgccagaggcggcagaggagaggtcttgctggggtctggctgaagcaagtgtaggcccggaccagcgcttgaggttttgggctcgtggtgagagaatatacacccaaagagctgagggaaagaaggagtaaggagaaagaagagcagaagccacttaccaggttttgagcccagttacctagaaggcatttgggaaacaaggaagtaggaagaaaggcctattttaaggaaaagagaatgagcttgatgtggatattttaaggtcaaggactagaagtctggtgtttttttttttttttttttgagacggagtctcgctctatcacccaggctggagtgcagtggcgcgatcttggctcactgcaagctccgcctcccgggttcacgccattctcctgcctcagcctcccgagtagctgggactacaggtgcctgtcaccacgcccggctagttttttgtatttttagtagagatggggtttcaccgtgttagccagatggtcttgatctcctgacctcgtgatctgcccgcctcggcctcccaaagtgctgggattacaggtgtgagccaccatgcctggccgattcttttttttttttttttctttttttggagacagagtctcactctgtcccctaggctggagtgcagtggcgcgatctcagctcactgcaacctccgcctcctgggttcaagtgattctcctgccttggcctcccgagtagccaggattacaggcgtgtgtcatcatgcccagctaattttgtatttttagtagagatggggtttcaccatgttagccaggacggtctcgaactcctgacctcaggtgatccgcctgcctcagcctcccaaaatgttgggattacaggcgtgagccaccgcgcccggcctggtgattctttaaataggtgattggaaatgttagcgaagtttaggaaagaattcagagctggaaatgtagagaaagaaaccatctttcttagtttttggggagtagatgccatcctgagagagagggagagacagagagagagaatcagaacactatgaagaatcttttttaagatgtctgtgaaatgaaagattttactaaatacattctaaaggagagaattacattagtaagatttcattaccctgcgcctccccttaaggctgatctttatttttttcctcttgtaactaaatcaagatgaagccttgcttttgaaaatgtcattaggattcagagactacaattcccacttggtagatggagttcttgttcctgcattgtggtgagtggatcaaagttcagttccagcaagtcactgaagcccctcaacatacagtagcactcccttggcatggggcaaacaacaaagctttatttatttatttatttttgagatgcagtctcgctctgttgcccaggctggaatgcagtggcgcaatctcaactcactgcaacctccgcctcccgggttcaagcaattctcctgcctcagcctcccaagtagctgggattacaggcgcccgccaccgtacccagctaatttttgtatttttagtagagacggggtttcaccatgttggccaggctggtctcgaactccggacctcaagtgatccacccaccttgacctcccaaagtgctggcattaagggcgtgagccaccgcgcccggccacaacaaagctttgagcacattcccagcatcagctcttggctggcgaagccagtctttatctcctgtcagccttggttttggtgttggttctccagaaattccctgattgtaaaatatctgatctcgtgaaaatgaagtcagcacttcccagaagttgagaggcctgaagggggagtaaaaaccgatttcaaatcctgcctggagggaacctgctcaggaggtcctggaaggtggaggcaggctctcatcgcctgtctttattaaataaagccctaaagccctagactgtggtgctcgaaactttttaagggatgcctgactcctcaagaagtctgtaccatttgaatgagctctagttgaaagaaaggtttttataatatattcaaagtggaaatctttcttactttgtttttttgtttgttttttgagacgaggtcttgctctgtcacctggatgaagtgcagtggcacagtcttggctcactgcagccttaaactcccaggctcaagtgattcccctgcctcagcctcctaaatagctgagactataggtgtgcaccactgtgttgcccaggctggtcttgaactcctggattcaagcacccacctaccttgtcctcccaaagtgctgagactacagacgtgaaccaccatgcccagcctctttctttcccatttttgagaagagtggagctaatgcctctttcctgcgacagatttctacccaagccaaaggcatttttgtcttcttcccccagcctctgttcatgcattttatgacccttgttgctgctgcttttaaagtgtcctaaaaccaaaaatgaaacttgccgtgtgacctgatcagcaagaaggagggtgaggctgtgacccctctcttagtgtgaggatgacatttctcctaatgccctaggctttttgttccttttcattcttttgttctccaggccattctgctggcttattttgggcttacagtcaattacaatccttaaatctttttcacatgaacttttggcaagctgggactaactccatgggtgattagagctgagggcttcttttttgttttttttgcaacttacgtacttaacctgtatcaccatgttcttgatgttggcatttttttggttttgttttgtgggtatttttttatttttgtattttcatcctattagccaatttatttttgtagaatagtagaatttggaactagaagtgattttaagagtactgcagtttgtttccttcgatactgacacaacagccctcgggaaactgacctggagcgatgggtgctaaaaggagatgagattttcttcctcatatgctaggagcctggacagataaaggtgtaaacaaaaatgttagcagagggttaggcactggctacgaattcagacttggaaacttcgttgtctgtgcaacttcatactgtttcattcttgtcctgtatagtatttctttgatttccttcatctgtaaaagcaggaagaaaatatttgccactcagttctgttttttaggtatcaaatgctaggatacaacctgaggtttctttccccgccccctcacaaagtatagatcatttgttttccttccagccctgggctcagtacacagatggtttctcttcaccttttgggttgcggttttctccaggttggtgctgatgatatgataaagctcagcacagaaggccttcaggtccagtaccctggccttgacctccccataggctgtcttatctcacttttgcaccaacgcctggtaatccattacatgggtctccttggaggccttggccacagcatccccgtgttctgagaagtatttggaaatggttgtctggacggcttgcactttggtcttaactgcattcaccctctccagcaccttctcctggattgctaccccaaatcatttgcatcctcagtcttggggatcaggtgctggatccatgtgatcaccagaatgcatttctctttgagaatccagacttctggcttaaccatggcaagcagcgacaggaccttctcattcccagggagaaatccacactcaaggacttctttcttctcttgcctctctgtttctacctcatccttgggtgggggttctgggatggggatgtccagtggggcccggagggaggtcaggcagctacaatgagggaatccttttgcaaggcctatgtgggtatatgattttctgtggcaagaatctgtagaggaattccttggcttcttggaaaagctcttgcctgaagacatgtacctgggtgtgggcctccctgctcaggcacccaccacaaggcttggccgtgcagcttcagttgctggatctctggtcttctggccagtcgcccgggctttcgcattcacagcctgactgttataaatatatattgaagttatctaacatttataactccgagaatgccaaggagcaatgaatagtattgttattgttacccttggtattgtgtgcagtctaaaatatataaagtggaaaatggattaaactgcttttaactaacatcctttattggcaaaagttctgatttgcctgttgatcaaagttaaagaaagggagtggttacttggtgagtgtagttgatttcaagaactgaaatggtatgagaggaaaacctgtttctaccgctgatcagaatgaagatctgggttcttgaacacatgtgataagttttactcaagaatgcagttagtgctgtaaagctagtctggcatattttaaaattgtaaataattgatagttataacacatgctcagagccctttcctgtgattgagcctggcactcatgaattagtgtaatttttctgttcatttggaaatgtgtaaatttctattcatttggaaatgaccatggacctcaaagatggtgacagggctgtggctgggccacactgtacatttgtgcaagttgcgggctgcacaaaggcacccagccagtggcacaagcaaggactgagatccaacccacacttggcttaccaaagtctgccacccatgggtttttgtctgtgagggggagaacaggggtttggctttttaagatttggacaaaggcactgtatatttgaggcatagcctatactatgaaatattttgtttttaaaaaattaattttggtgctgtcaaggtgattccgtactgtgtccacatatgtaataatttgaatcacatttattttactgcaattcctgagaaggaacaagagtatttatctggttaacacgctaatggtttatctaaactcaagcttgaaccattagcttcacgagacagaccagtgcttagtattatcacaattttaatttaagctacaaatcttcatcttagataattatctatgcaaatgcaggggcagtcttttgaatattgcttttagactgccatctaaagtttttggtttctggggtttatttggaagtttgtttttgtactgtattgtgcttcctgacttaaaggcttttgtgtgttatgtcgtgaagcatttgggggcacttagaactgtatgccgtttcacttgtacattaaaagagtttatcctaagatgaagatttttttcttctttccaaatgattttgcccctagaagtttttacctagtagcagtagatggtaactttgaaaagactaaagtttaagaaaaatgtacttttaaaaaaattaaaaataaccttttttatgattacaaaaatacatatatatgaaaaataacatactgataagcccaaatacatattcctaccacccagagaccaccacacgtagtcccttccagatctgttttattaataagcactattgaaaattctgtctcttttgctggaaataagtagaagaaataacagctgttcatatacatttactttttttttttttaaaagagaattttttgccagaatgccagagtagactgagggtggatgggcgaggggattattctctgaggtgcagcacaccctggtttcactgtctgcacagttcccactttttgttcagggataagatgtctttgagaagagaaaacccatgtgagtaaatattgagttgtaatctgtattcggatttctggattttttttggtcacagtggttctgccatctagccactgaaccctcccaacctttccccgtcctcagccctcatctgtcacgttcagttaccacttcttgccagctttaccttctagatagttcttgacttcatcctctcctctccatttgtattgccactgccctaggtgagatcgtcacttctctctcctcagttgcttgtctcttccttcatcagtgatgtattcactctgggtgtgaggggcagcgccaggcactgggttacaagacccctgtctccagcgactgtcttcttgaggacgaaggcaggtgaatgagccattgccacttcatccttctgcctgtcatccttcctctgctgttatgtccatcaagcccattctctccccagcagccctggtgatccgttggaaatgcaaacctggccaagtccccacctcgcagtcctcagctgtctcagtctcagctgtttgctggcagctgggtcgggctgtcctgggcctcctccacacctccctcctcgtctgcctcccctgaccaaccgggcctccttgctcttaggtggttttctctgtccctcccctcctgacctcccctctttgcacgtggtcagtctccttgcctctgttgccttgttttctaaatcatgttacctgtctgtccccactcttcagcccagcgcacagcacagtttctgacttgatagtctgccttctgtaaaacgggaatgagggtgtcttcttcagagtgttggtgtgaggattaaatgagatgtaatccactgaaagcatggcctctggcacacagtgggcctgataagtggtattgatgcctgagatattgtattaacttaaatgaccaggttgaagagaaggtgtcagaaatttacgttcctccatgtgtatttgattatataaaatactgttggtcacactttccctacgtcatattaggtaaagttagaaagtgaaggcttttccactgggcacggtggctctcgcctgtaatcccagcactttgggaagccaaagcaggtggatcacttgggaactcaggagttcaagaccagcctggccaacacggtgaacccctgtttccactaaaaatacaaaaattagtcgggtgtggtggtgggcgcctgtaatcccagctactctggaggctgaagcaggagaatcgcttgaacccggaggcagacgttagttacagtgagctgagatcaagccactgcactccagcctgggtgagtgagactccgtctcaaaacaaacaaaaacagaagaaaaaaagaaagtggaagggttttatgtttctttcatgtttaacctacatgttgtaggtaaagtttacctacaacactttggtgtattttcaagtaaatatatttaatcgaagtgaattactgttacattatgaattttacacttttagagaaacagaaactgcctcacacattaaagtgtgtgtgttaagcaaatactctgatgtaggcccgcaaagtacacagaaacgaatcaaacagcatcctgcccccagcgcgtggtgtaggggaagggctcagggctatgacaggtgttacagcagaagaccaggtgccctcaggacctgggagagcaggcctgtggggggagggaggggaggagacatttgggttggatctggaagaacctgcagacactagtggaggagagtcagtggaagaacattctagaggaaaggcttgcccacttgcctgcagtggttgtcagatgtgagctgcaacctaattaacagtttattgaaatgagatatcaaaggtatttattgggtatgcttttcttgtttttccattggcagtgataataccaagttgacagttgaaaatgcttttccatctgtttctgtattggactgagttgttgtattccaaggactagctaggcaataaatcacatcagactaaaattgagtacttgtaacatttgaaaagattataatgtgctggtattgatgaagaatttatactgtgtagaaattaattccattattctaactaatggacacttgagttttgccccattagagtttgctcttcatgttgattttaatttctttgatgactatagcgtctggcgaggctttctcattttcaagtggatttgtttgcattggatggtggggctggctttattgcattattcatatatgcaatacatatgcaccatggtcccaagacatgactcgtggtggtggtgattgtatttttgagatgtagctgatacctcccatcctctggacttctttggttcacatctttattttcactaaccagtaactgaaaatctaatattttctttgattttgaatgtagtcagcaaacccagtagcattacagatggagtatcccttatccgaaatacttaggaccagcaagtgttgtagatttagggctttggaatatttgcattgtactcaccagttgagcatcccaaatctgaaaatccaaaatgctctgatgagcatttcctttgagtgtcatgtcggtgctcaaaagtttccaattttggagcatttagattttggatttttgggctagggatcctcagcctgtagcagttcctgtgactataacatcaataaaatcacagtaccatgatctgtttctacactgaacacttctgacatcagatgtgtcagagttttccccacaccagcaaccagttctctgattctctggtcaccaactgggtctccagtgatcagttaaattctgacactaacaacctgaagttagcacagaccccacaagttaagggctcagtctcacaagactgccccaagatacccactgacctgctataaatcaagttcccaccacctcctcctcagggtcagtcatttgctagaatggcccacagaacttagaacactctttacttacatttactggtttattataaagaataccactcaaggccgggtgcggtggctcacgcctgtaatcccagcactttgggaggctgaggcgagcggatcaccaggtcaggagatcgagaccatcctgggtaacacggtgaaactccgtctctactaaaaatacaaaaagttagccgggcatggtggcgggcacctgtagtcccagctaatcgggaggctgaggcaggagaacggcgtgaacctgggagtcagagcttgcagtgagccaagattgcgccactggactccagcctgagcaacagagtaagactccgtctcaaaaaaagaaagaaagaaagaaagaataccactcaagaagagccaaatggaagagatacgtaaggcaaggtatggaaggggttttggggtgtttagagcttccatgcctctttgggcctgccacctagcaacacctcgataagttcatcaacccaggagctccctgaatcccaccatttaagggtttttatgaaggttccaatatgtgagcataatggattaaatagttggccattggtaactaattcacctttctcccctcccaggagatataggttggggagtagggtgtaaatcccaaccctctaatcacaaagttggtccctctggcaaccagtgccaatcctaaagctatctaggacccaaaaagagtcacctcattagcataaactcaggtacagttgataggggcttattatgaggcattcctaattccttattataaggcattcctaatattacccagttccctcaggaaatgccaagggttttagatgctcttgtgtcaagaccaaatagttcttattatatcgcgatatcatgtcagttatttccatatgccttacagttttatacatctctcaaatactgtatgtgctcatcactgctttaagttacagtaagttattgacttgctgcttgatcttgttaaatatggcagtaagcacttagtactatatcataattatttggataattccctttcagcataattgaatcttttgccatcccttgtgttctaatttatgcatttgagaactttattcttcagggtccataggcttcaccaggctgtgagaggggtctgtggcacgaaaagtttaagaatctctgcttcagtccctgggatgtgcttgagagagagcattcctgcattcgttcaggattggtaggaatgtggggtgtgtgattgagatgctgtctctcacctaagactaatcccatatagtcagcagcacacaatttaacaaaacctcagtcgctcttgggggcattgtaatatatacccaccataaaaaagaaagggttaaactacattctctgtaggctttgaaaaaatatactaagcagttcccatccaaaaatatttaaaataaaaatagccagacacaaagtcttcagctgtctagaaaaatcttataatacaaaaggaattactccccgtgtttctggtttattatttttacagcatctgtttcttctgcaaatatttgttgtatgcccactatgctcaggcattgtgttggagatttacagatttatggtggttttctcttctaagacctatttgaaatatgtctttctcattacttaaaaactttgaagtcattagatcgttttgcattgcaatcatttatacattgagcagacttattgaatacttgcagtatgccagacagtgtactaggcacttactttgtcctacataagtagcacaatagacagtaatcctactctctgggagctgacctttatttaggtgttttgtgctctgaggcttagagggctgccttgacgtgccataaaaactgcttgacgctcttaaaaattatgggtggccattattttagattgagcttctctactgggccccagctgaacataccaaaccaaaatggagtcacttatgctaaaggtgatgtaatcaaactgaaatgttaagaaagcagatggatcccagaacagaccagtttaagaaagcagatggatcccagaacagacctgaaaacaggagattccagtctacctgagtcagcatagcaaggaagtcccttctgctttatttagcccttacagaaaagtagcctgaagtaacctgatgttaaccagtcaggtttttctattctgtttctttgtttccatcttacaatacctactgttctgccattgcctggtgggagctttcattcgatttggtagaatggagtcttccctgatgtatgaattgtgaataaaatacaattagatctataactaaatttgttgcaattgtgtcttttgataccactcacagacctcgtgtattttgtaaggtagtggttttcacactctgttcctgtgggtgtttatgatgtctagggctggcagaaggaaggagggggacatgttctgtttcctcagccccattttaatcagaacattcatactcatatttgagattgccggaaagttgaggatggggtgagatggagagttttgttgcctacagggtgtttggaaatttggtcaaaggtttgaatatgactggcattatctattgcctgctgatattgtagaaattatttttgtcatttattattcgttctgtactgaaaggtagatggaagcttgttgcctctaggtactgatattttaataaagttggcagtcagatgtggtggctcatacctataatctcagcactttgggaggctgaggtgggaagatcccttgagcccaggtgtttaagaccagcttgggcaatatggtgaaaacccatctctacaaaaaacaaaaaagctagccaggcatggtggcatgcacctgcagttccagctacttgggaggctgaaatgggataatcgctcaagcctgagaggttgaggctgtggtgagctatgattgtgcccattatactccagcctgggcaacagagcaagaccctgtctcaaaaaaaaaaaaaaaaagagttggccttttcttaccttacaaacatcaaggtaacagctagcatttattgggagctattataggctaggctctatgctaaactttcatatttaattttgtcctcaaaatgaccctccaaggtagctggtaatgtctcattttagtagaagaggagtcgaggttcctagagctcaggtggcttgcccaaagcagtgcttgcagcttatttcagcattccaagctacagagttccccataggttctgtcagcatcacacattcatagcttcagctgcctagcagttagggctgactttctcctgatagttgtgaccagcaacgagagttcatctctactcttttaaaggttattctgttttagttactgctccagatccctggctccctccggatggaatgtttgtggtctagtaagcagtactgggctcactctcatatctttgtacttccctccctccctcaacctgcacacactaaacaattttcttacactgaaatgcaattagcagtcctggcagtttatgcaaaggttgggatttatactcgtcacacatttaccaaaatgctttattattgagcagagtgcctgatggatcctgaatatgccttttttttaaacaaaaaagaaatcttgtactttctttttgtacagtgtttgcagttaatgaaatcaatgccttaattacctatcagaaaggaatgagatggttctaatatgggttctagtgaaatatgccctcgatgataaaagttagttgcagaacactatgatcccacttaaaaaaattggtaaattaccattaagtgtacacaaagaactacacaacagaaaagccagattgttaactgtagatgtttccagggattatgggcaactttatgttttcctgtttttcttttatgtggatgtgtattgaactaatttttagaaaccgaagataattaaagagtacattttgtagctgtgttcaaaaaggatagattattgaaaaacggtaaaacatgaatatttgttttccttggttcttgaggttagcccttttatgccaaggcaaaatgcctcagcagcaacttaacgagcccagaagaagggtctgacctggctccctggcagggagggggagggagagagcaaagtgttcttctccttccatctcccccgcctttctgttcagccgtaaccgtcttgcatcttcttggttatgaaatgattgacctttctgttgagcctaacaacacctctgctggtgctggtttggattggaggccccaggatgcggaaaaagggtgtgtaagaggagggtgctccggagatataaatgtgtgctttattttcctcctaaagcaagaggatagggaagggaagaatgcaagagcaaagcttacatttttcagtagttgttgcagttctgatacattgatctcatttgttgtggtttaaatacacagagtgagatcgtaaggtgctggctgtctggggctagttctacctgaatcttgggtattgtacattatgtgagaattaaggttatgatttgatttgaaagactaggctgtttgcagcttcagtagggagtgttcagagatgttttccttccctggtgtttatgtctgggtgtgcttgtgatcccctagcctggcttctgagacagcagtgcagcctcctgggggatatctctgtttcttgtggcttctggcctgagccccgtacagggaacttttcttttctccttagttcctctgagggaggaaagctttatcttttaccttagaaatgaagtcctgccctcagagatctggctaaaacccaaaaaattcctttgctgtgtttttcattgaggcagattctgtttataggtaagcaaagctggatgtgaaccccagagagccagcaaggccatgtgacttctcagctgccccagtcactggggagcaactccagtcccactgctgccatgccaggggactgacatggagaagacatgatgccatggtagaaaaccgcatttccagagaagcacagtcacctctgagtgacacattagacccatgtgtgaggcgttgtgtagatactttgcaaattacccgtgttttttggtcctgtttctttgtccacttgtattgtatgtgattacagccctttctcattttacatagcagggagcagagagggcatgggaataaggtgcaagcattcaaacatgaattgcagtttggctgtggttgttaaaaatttttgatatgagctaaaattttattaaatctccttttttatggagaaaaaaatagaatcagtttggaattccaggaggctttggtgacttttttttttatgtattcatttcattagagaattaggtaaaccttatattacacagccaaggccaaaatagttttgcacagttaaagtgtgttcaagaaaccagtcaccatttaactggattagacttcaacaaggagatgataacctccaaataaccttcctttaggaagatgacattcctccaatatgtggaaagacagtagatgcattttcttctctctgccacagaggaagaaattttccctcttgagggaccaacactattttttttttttttttttttttgagatggagtcttgctttgtcacccaggctggagtgcagtggcacaatctcgtctcactgcaacctctgccttccgggttcaagcgatgctcctgcctcagcctcccgagtagctgggactacaggcatgtgccaccacgcccggctaatttttttgtatttttagtagagatggggtttcaccatgttagccaggatgggctcaatctcctgaccttgtgatccgcccaccttggcctcccaaagtgctgggattacaggcgtgagccactgcgcctggcccaacactatttcttttatgctgctcttttcccctctcctttctttggtttcccctttccacgaagcttcttttgtcatctttgctcatccttaaaatcctgatgctcatctctgcagaatccaagaaaccagagtgttcccatgagtgtggagtaagtgttgtcatctggatacccagtcataagtctccttcttcttggccaagggtggttcactaaacagtgtcaccattttcatagacttggaatcagtcggcctggcgacttcaccaaatagctgagcactgagacgagacatgcgcagggcatattctgaaagagaagacatttcttgagtggcaaggaactggagtccctggacttgactttcctcacccacacctggtgactggttttattttaagaagggcggggtttggtaaatgtttggcatcctatctgcttttactttttatttttttatttatttattaatttattattattattttttgagacggagtcttgctctgtcgcccaggctggagtgcggtggtgagatctcagctcactgcaacctttgcctcccgggttcaagcagttctcctgtctcagcctcccaagtagctgggactacaggcgcctgccaccacgcctggttaatttttgtatctttagtagagacggggtttcaccttgttggtcaggctggtctcgaacttctgacctcaaatgatccacccacctcagcctcccaaagtgctaggattacaggtgtgaaccactactccctgtccctatctgcttttaataacttatttgaaatgcaccctgtactgagattttgcatttctctatcctcaacctccttagtacttctgtagcacttgctttccaccctgtttagtcatttatgtgctgctttattccctctgtctagacagattcagtcttttttgtctttgccagtttgttcatctctgcggtaagcatggtagggatctgtgcagtttggctgcccttcgtgctgttcacagtttgccaagggcctccataatgaaatggatttgggtaggatggtgctgtgggtggcatgcggaggaggccttcctatgaagccctgccttccctgggatgtgacaaaggacagctgatgaagccaggcttctggactctggctgcccgttagaacagccagggtagggcactttgaaaactgcgggagtgagggccccacctccaaacaagctgcttcatttaggtgggtggacctggacatcagggcttgaaaatactggccattcccatgtgcaggcacatttgagttgagaatcagtgctttcagtgaaggggctggactttgaggacttatattctcatccagattgaatattcagtgattccatgaagtctatctatatttatgctggccacccaacattttaagttttaaaaactattttagaaaacctacgaaataatttcgtatccttacagtgcaatcttcctttttctttctcacctcctcccaccctcttttagctcctacagccattcgattacttcttttgtggtttcatagttttaaatgtttgtagaaaggtgttggtcagtcagaaggttgtagtgaatcttttaaacaattattttggagtacaaactatgttttgtgtttgcatagaccatctctgtggggtttaaaagctactaacagcttatccaatttgccatttcacaaccagggaagctgaataatgctacttcttttttacatgggatgaaagatcaagacccaaaggacagaaagataaggcagaggggatgaaaaaggggcccctgtgtcaggggctaacagtcattagcacttcacctatgcccagatgcctcctcagccagctaacagggacacctgatcactccttggcaagatgtaacacattaatctgacctgttgtctaattgtaagcatgaagcaggcattgaggcattagatcaccacagcatgaagcaaaagagccaagacagaccactgcacaggagcggccttctgtgccttcgcccatgtttgtgttctggcacctgtcaccttatattggaaatcacatatgcgtgagcctcctaaagtcagagggaatcatgtcttactcattgtaggaggcatattcaaatcttcatgattgaatctagtcctgtcaggctgagctgctgcataatatgaatgtttacctgtgtcctatctagatagcaactgatggtattttctgtttaaatgatttaagtaataggcactcatattttctcaagtgttttgcatgaaatttaaggcatgtaagatagagtgaggaaatacttggtttaatttagtttttacccccttcctttataccttacgaccaacaaatacaaataactgcttgtcaataaaaacaagccacaaatctgttccttctggacaatgattacgtagcattttttttgtgtgaagtgctcatttgaactccttacaatgagaaagcatttcatctaagggaaaaaacacaatgtgtccggccatatttttgaagtcttagaatgtgttaccatcatataacgggaaaaatgctagaattttaaatacacagtgcttcagacttatttaatatttgtttcttacttgttgacagaaaaacaaagcagcaaatgtaaagtaaaatgactttttattctaaatattgtttcaggagctctttcctaaatccttgtgaataaaattacacttgcagtgtatttataatcctttataatccctaaatccttaaaaagcaagttgacccaaatgtttaaataaggactttatttacagaactgaatatttctaattctcttgggatgtcattatctggctacatatgaaacagtattcacttatgcatgcttcagaaacttcatacattactgtgcatttgttagtatgtgaacaaagaaacttgttttggttgtgagcaaaatgcagacttactttcaaaattgagttttagtataaactcaaataggttggcagaagaggagtttaatttttatgtatctaaataaggcctgtttcttcattaaaagaaaattaaaactaagccccacacccttattgaatctgtcccaataagatgctttttgggttcttgtttgtgctatagttggttttgatttacttcgtctgcaaacagaaatgacgtagatactattgctccaacaaaactaaaaaaagattttcactaaaagtacccagatcatatcagtgggaataaatccactggcctcagtgtatttgcccaaaaaggatctgtgttttgcagtaaatattgtaattggaagtatatgttcttttagactaaataaagttttacttgaggacatttttcagttaggcatgtttattttgggggtttagtattgtcttccgccttatttatttttacttatctgtatgagccaaagctccagccagctctctcagcccttatcctgttgtaagttgctgactccttttcttgaagatggagtgtcccctttctgggcgtctctaacctcatccttgcctccccccaggtccccatcttctctgcctgcgattccttagtttctctacacctgaaatgttggggtatcccaggagcctgtcttggcactcccttcctttactttccctcccggatgtgagctgctcatgtccagcttagactccctgtcttggactctaggcccacttacccagctagatgcctttactttcaagtcctcctggtcttaacatagacaaaagcagaactcattgcactgtctccccaaaccttctccactctgcactccctctgtgaactaatggcacagtcatccacacagaagcctaagccagagccctgggtaccacgccccatcttcaatatcctcagccccctatccaggtcaccaccaaatcctgttagtcctgtcttccagaatctttcattcagcctttctctcagccttcctctcagccttcagtgcttagttctttctcagttcaggctctcaacatgccccatctcaattaccgtaaaggatcctaattaaacctcctcctccgggcagggactcatttacattcatcttatatttctgaatccctggctctggcatctagagatgcctagaaaaatgtatagaaataaaatgaagtaaatgactgaagtcctccatgcaaataggtgagtccaggacagagttagaaggataaagaattcaggattttataacgagtggacattatgccttcattttttagaaaatagtgcctcagaggctgggcacagtggctcacgcctgtaatcccaccactttgggaggccgaggcgggtggatcacttgaggtcaggagttcaagaccagcctgaccgacaaggagaaaccccatctctaccaaaaaaatacaaaattagccgggtgtggtggtgcatgcctgtaatcctagctactcgggaggctgaggcaggagaattgcttgaacctggggggcagaggttgcagtgagctgagatcgccccattgcactccagcctgggcaacaagagcgaaactccatctcaaaaaaaaaaaaaaagaaaaagaaaaaaagaaaaaacagtgccccaggtccattctggtagagggttttataaacttacacacagatagaacccattttttatttagtctcttagtatacttgactaacttaaagtaatgtttaaatggaattaggctttttaactatttgcaatttgttgttgaaactatatttggcaatatgccctttgccttcaaatgttctgaaattgttagacctcaattatctcctttatatctgtattacacataacttcttggtgcttctgaatgacggggcacaccttaccctgagcatgagaaccttgagctcaattatgcctgaatactaaaacttagcagagcaaggagagagagactttggtctttgactaaagtgtgtctttttaagattctgagtaaaggataggagagattggtccttggaaaaaaaactaccacaacctcgattgtgaccaagttatgaggtattcttcagtttcttctgaccctgggaatccaggggacagttaagtgatctactttgtgtcatctttttgtttgtaccatttactactgagtcaccaacaaattcatgtgacttcacacattttctctctcctttgatacataatgaaagacatcactgctcacttcagatgcagcagaagacacagcatgtagaaatgtcaggtattttcataagcctcagaggactgaataagctttgaattttctgttcagagtggggttagtaattgggaagactcacgtgacttgataaaataatcttacacacttgcttagaagagtggcaaggttcttgtataaattgattatttttgtttgacaaatgttctttacagaaatcacttttaccaggaaaatcttataaactcctttttggagagtaactatggctttttgttgttgttgttgttttttgttttgagacaaggtctcagtcacccaggctggagtgcagtggtactgtcttggcttactgcagcctccatctcctgggctccagcaatactcctgcctcaggagtagtggggactgcaggcgcacaccaccttggctggctcatttttgtattttgtatagagacgaggtctcgccattttgcccaggatggtcttgagctcctgagctcaagcaatccgcctgccttggcctcccaaagtgctgggattacaggtgtgcactaacatgcccagtctaactgtggctaagtttttaccaggcttctgttgtgaaccattggcaaagatgtgaatgaaacctagacttcatgctctcttctctctgtcctgtcttctttttataattgaccaacagtttttaggcctctgtatgatgtatgattatttggcagtataaaagtgggctataaccaagcaaatgctcagtgcagacagatgcttgacctgttgaaattttggctattttgttttttttgagacagtcttgtgctgtcacccaggctggagtgcagtggcacaatctcggctcactgcaacctccgcctcccaggttcaagcaattctcctgcctcggcctcccaagtagctgggattacaggcacctgccaccacgcccagctaattttttgtatttttagtagagacggggtttcactatgttggccaggctggtctcaacctcctgacctcctgatctgccctccttggcctcccaaagtgctgggattacaggcatgagccactgcgcctggctgaaattttggcttttaaaatcatttaggtctcatcaggtatcaattatttaaaatgtaaaactttcctaaagatcttttgactctttgtgtgataaaataccttgaaagaatagtcataatctttatgacagagagatctttaaggtgtatttgatatgaagtcacaaagagaaaaatctttcgagtcattggttttgggaattatgtcatgaacactgaatataaggatacttttaaaatttaaaaccacctcctttactgtatgtgttgatctttgacctgaattggaagggggatttttaaaatttctctataatgttgttaaaaagacatagggcctgtgggtattgggccttaaattgaattttccttatatagaaaaatggaaaaaattggtttaggtgttaggtcataacaaaaagtaggcccttttgaagattaaatttatgcctgccttggccttgtttaaatccatgcctggccacaaatattagtgttgtggctgtccatcatctgagcaattgcacagctgtttcattcactgccgtgcggattcatctttatgtctatgctgctttgaagaaccttctcagaggttaatgatgagaggatgtagcagtagggacaacaccgtggcagatgaggtcttttattacattcttttaatcatgattttcagcattagaaaccaaaagctttatagtctccatgtgaagaatccctggtgagcctgtttgctgtgataatattagtcatgggttactcagtccttgattaaaacctcctagctttgttgacttgctagtcactattcacctgctaggaaatataggactgagttgtcatggaaggaaataatggtgctgggatttgaataaataatttatgagataatttcagagcctttgtcttcttcatcccaccatttattaaagaagactttccaaagtatactgccatgagatctagaataattgagtcatgttttgtgaaccacgttggagacagacttctctgggaggcgacagcttctccagaggaggcctttagctttggagtgggaccagcctgggcttgaatccaaggcctgctaggttgggctgtgtgtgttcccgggctggtggtttaaccttgcagggtgctgtgggcatgtaaatcctccagcgcagcccttggcaggtaagaggtgcttcataagtgtcgtcccccttctcttttctgtggaagctgtgtgttcacctcccatgggaagacattcctagtcccctcccgtgggctcctcctccagtgggctcctcctccagtgctccgcagtggagtagccagcggggcgtcccgaaagagcatggtgcattcattccgtgagtgccagccacactgcatgttccaaataacacgcctctctctctcctcaggtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacggtaaaatatcacccagctcgtgcacagccccagtctgccatacgctttcaagagaaaatctgctttatggagcgaagattcttagtcaattgcttttgatttatgtgtgaatccatatattttcatgctgaacaattctattcttaggataagctccttcctttagccataagcctttacagtcatcagggagaaacatgcccatgtgtaatttttatctcacccggtaattataaagacaccttttcagtgtggaaagaacagtgaaaacgtgtaaatgagaccagcagagagatttaaaaaatatatatgaatttcagatgatatatttcaacagaatcttttagttggaaaacaccctctctactattaatatttttatttatgaaacatttaccctttgctaatcaggaagagtggctttgtgagtgacattatatttgaaatttatacccaaactgaaatattaatttagccaatggcttgcttgctttttttttttttagaaaaaaagtgttaaattgacagccaaatgctagaaaaggactgaacatggggggctgtcccaggtgggtggggttcctggttccatgctgatctgggctcttctgaatgggtgtgccctccctgggagtcccctgggtctgaacggatgagatgtggagctgtcccggcagcgagccggtctctgacaatggaagagctagtttcttccttggccttctctttggcttaatgctgactgacgttctgtagagaacaaaattatcttaaatataaagtctccttcttgtgtctaattcagggcacaggtgagatggccagggggtaaaaaaccagctacctaggttagtgcagtgtggatgtgtgcaggtttaaaaccaagggggtgcacccaagggtaaatagggctgatgttttcatcttttgaccattgatctagtgtaccgaaaagagtagtcagatttgtgctttaatttgtgatctgcatcttttaaaaaaacttccttggtgacattgagaaagctgctccctgcatttatttataagtactgactgtttgactgctgtgctaacgtcccttgccacatgctggaaatgcagccgtgaacaagacaagtatgttctctgcccacatggaatttagattccagtaagggagacaggcaactgagtgcacaaataattatctaattataattgtggtaaatgccgtggaggagaagtacagcatgcctgagagcatttctcagggtaatcaggaaaggcttctttgagaaagtgattttcacctaacacaaggtttcattgtggccacctgggaaggtcttctgggctcacagagcagcagatgagaaggccctaaaggcagggatggtgcctggtgcctggagaatcccagaggcctgactgcctcctttgctcagcattcttccctcgagttgtcacggtcttacctcctcttgcttcctttaggtctctgctgaaatgttgacatggaggaataatcgtatcagtaagaccaatagcagcctcacttcctgcttttttgctttatttttctccatggcatttttaccatttgacacaattacaaataaacaagtaaaagattttatgtcccacatgcccccaagaagataggcttcaagagggcatggattttcatttctctgttcactgctgtcgttggtagtgcctagagcacagctgttgggtgagaaataattccagatggccgcactgaaaacaaggaaggatggtgcgtagagatggggctgggactggaggcagccccatgaaagttgttttcatcaggcacaactttatgggtcttggtcagggttttgttttttatcctgaaaggagtgggcagtcactgcatgctataaaacacagtgtgaaatatctttggctacagagccaggatacttgggggagggcaagagtaggatggggaggggagtgaagctgttgtagtagtccaggtgagagatagtggggttgtggtaagtgcagtgggagtggaagggacagacatgcagaaagtcaaattaatgggatgtacaatcctttggatgccatggggaaggagagggatctcaggagccccacccaactttggattctgacttgctctttacaacccagccatagctaagtaataatgccttggagcctctcaccttatgagattttcaaaggttatttttaaaaataagtaaggactatcttcattatgtaggtaaagacagtgacttctaaagagactaaacatactccaaatagatacttattcgttgtttacaaataaggaggatattgtgttggctcctactctagagagagacacagtctagtttagaaagatgttgcatgttaaaaatgaattagtttttcatcatccttggtctccacagaaggacaagagtaaaaggctacctgccactctctgctggctgaaatacagttcagaaacagtaagtgtgcaaaaacaattcagaatgcaaagtccttgccccaaacagaatgcacgtttcttgggccccctcattgagagtataattccccttgacttacaccccagtttccaacaagcttgtgtatctgatttgtattttacatcaaagcgtaaagagtttagaggaggagatgggtctgggagttaagaatggcagcgtcaggatgtgaccactgacttcttggtcctgaggagaaactaaagctgtagaaaccaacacacactgaaacccaagaagcttagcgctccagagacgaggagtctaaaaggcagcctttcacagcctgcaggggcgtgtgcacacagagtaggttgggtattgcaacacagcagtctcctataatgcatgtctattagcatgtcccaaggcagtaagaggattgtaattgatgctcatactctaacttgaaaaggtccggtcactagtgtatgtgaatgcctcacatgtaatatgtactaaacaaatggtagattcttttaacaataatttaaaaagacttgtcagtaaaaatcattcaaaagtatcttggaagctttgaaagagtagattctgttttctggaaggttcacttatgcggagacctcagtttttagggggatgtgtggatcttgaggcctattgctaacttttggatatctggttctttcatctcaaggaagatggctgtcttatctaggtgaaggcactaatagatgtgtcttatgacctgaaatccagaggataagaggggacctttgaaatgatttctacgatgatagagtcagaattttataggagcttgtcccttttattctttattttcataggtcatgaaatgagaaagtttgaaaagctagatttttttgtttgtcttttaagattggccagtctgaagtttacctcatcagtcctgacaccaaaaaaatagcattggagaaaaattttaaggagatatccttttgctctcaggtaaatggagatgggtttttttattcaattgcaatggaatttttaaatgaatttctataatatctatcatgtaacaaatgctaaaggttacaaggtgtatgttttctaagtactgtacttgatttgtgtttcgcttttcttctttgctttggtatgttaaggtaaattatgaatataattttgaaattaagaaatttgctcttagcaacagtaatggacaaaatagatctacttttaattttctcagttattggtagtaataatccacagtcatgacttccagatgcacatgtgtgtgtctttgtgcatattacacatatatatttacacatttcacacaaatatatctttttattagatatatttctactttacaaaaatttgtaacttttttgggtaccaattgtcagtattctcccttcaaatatagatagtgcttatctttgacatatatatttacacatttcacacaaatatatctttttattagatctatttctactttacaaaaatttataacttttttaggtaccaattgtcagtattctcccttcaaatatagatagtgcttatctcagagtacagtgtctacttgaaaacttttttcttgataatcttccaggtgtttcatagagggattttggaagaatctatcaattaagattagctgtgccagttttactcaggatcttcctaacaaatatgagatcacttaaggttatatttgcttttttttttaaactctggatttttcattttcataattgataaaatatgaaaatgtcagtgttgatttataatgtgatctacttaaatattcaaaagggacttttctgcaaaatgtgaaaataaagaatgttctttacagattgaatagggaaccatttacaaagaaaaagctttgctaaatcatatttccttaagtggtagccttatgcttaacttgctactggagaagattaattgagatggcaaagcatgttaatgattgctcatttattggaaaatatttggcctgaaagtgagattacccatagagtttttaatcctgatttgctgctatttctgttgaaatatgaatgttaaatgtttacatttttgtgtgatagctttataatttcctaaagagtgtagtttacaagtttatatgattacctgaacattaagctatcagcactcacatctctgcatgatgatgctttcagaatacattgatgtattaatatttatggcagacgttttatctgtattaaggtgcctctgatagctgatgattttaaaacacatttacatattaatatttattaaaaatagctcttatgataccatggtagagccttggcctaatatgtttaaaagctcctctactctgtgtgcatgtaatttttgactctttctttattccagttcacttcagtatttacctacttattttaggaatacaaatatattttaaatatttttttaacctttgggtgtgtatgtgcttagttgtgtttcttcatgaatctctggtctgcctttgattttttgagtggtttttattctttaatacctatgtctcaaacaaaacaacaaacaaatactaaaatgagcactaaaacttgaattttcagatcttatttttcttattgttgtgggagtaatcaaaggaacattctagtaaaccaactttatttgagatgtttttagactttttgaaattttaaaatatcagagaaaatagtaatttcctagtgttttttaaaattgtgctgtgtaggccaggcgcagtggttcacgcctgtaatcccagcactttgggaggctgaggtgagtggattacctgaggtcaggagttcgagaccaacatggtgaaacaccatatctactaaaaatacaaaaattagccgggtgtggtggtgcatgcctgtaatcccagctactcaggaggctgaggcacgagaatcacttgaaccctggagacagaggttgcagtgagctgagattgtgccattgtactccagcctgggcaacaagagtaaaattccatctcaaaaagataataaaaagtaaaataaattgtgctgtataaatcttgaggtgcatttctgaggatggtgcgtcttctggatacaactgaacatctcgttctctccctttggcagggcatcagacacgtggaccactttgggtttatctgtcgggagtcttccggaggtggcggctttcattttgtctgttacgtgtttcagtgcacaaatgaggctctggtgagagaggacaagcaattcttaccttggaaccttctttacaaggaattttagctccactgatttttctgtccttagggaaaaccagatggtcattgacatatcattatttgtctttagttatttacttatgactatttagtaagcagctaatacacatctgaagcttaattggctgtgcattttatattttttatttctgaagaacttgtttagtgtcaccttctggtctagcattttacaatgtcattttagacatctgatcaaaggagtttgccttttttctcagtagtttgtatttttagtttttactgtatcagtctgttctcacactgctaataaagacatacctgacactgggtaatttataaaggaaagaggtttaatggactcatagttccacatggccagcgaggcctcacaatcatggcggaaggtgaaggaggagcaaaggcacatcttacatggcagcaggcagggcagcgtgtgcaggggaactgccctttataaaaccatcagatctcgtgagatttattcactatcatagaacagcacaggaaagacccactcccatgattcaattacctcccactgggtccctcccatgacatatgggaattatgggagctacaattcaagatgagatttgggtggggacacagccaaaccatatcatttaccttacctgctttaagagctttgagcatacttgtagtattttcagactgtaatcctagctgttattccaattattatctgtcaacctgtgaagagtagtacagaaaactcttaaagcttaaaaaatcttttccaaagattttctgacatctcagcccagctaatttcaaattgactttttggtgactacaacttctcttctctttgattaggttgatgaaattatgatgaccctgaaacaggccttcacggtggccgcagtgcagcagacagctaaggcgccagcccagctgtgtgagggctgccccctgcaaagcctgcacaagctctgtgagaggatagagggtgagtaggggaccctttccagcatgaacacagtgggagttaaaggtcccaggagaactttagatgatactcatctgttggaagattctgcctaacagaggcttgtattagtcacagggattgtaggtggactctcagtgtgcagtgggtgtcttctgtatgtcaggaattgtgccggatgctggtgatacaaagataagaacccagaacccccttctgccacctccctccaaggtattctgaggatggaggaggagttagggaaacaggttaccaaaccggttgcctagtgtttatcaaggttgtgtgagtggtcagtcatactgggcactgcagagatatctagaaagataagaactaaggaacttgtaccagtttctccattacaaggtcattagtaacgtctgctagtacagtttggatggagaggaggtagcagaaaacaggttgcagttgaggagcaaatgggaagaaatcaaagaaacggtgactattagtattgaccagtatttctagaaacctggcttagggagaaactgtaataaatgttatgatttgtagctaacgtgtattgaataagatctgccaggaagtgtattaggtgctttctgttatctatttaatcctcatcacatttgtgggaggaaaagggactatttattttgcacatattgcagataagtaaattgaggattagagatgtctaggaataaactagtgtatagtgagcccatgattcaccccaggcggtaaagccctgttacctgccaccaaccatttccaggagaaggccatactggagaaagacctggggattgcagctaactttgtctttttcagaattggagggtttgagtgaattcagagcccaaggggccagaggggccgaatgaatccgaatggaatggtgggggttcctcttgaacaagagtggggagtccacctgaggcaggaagtgagagtttctgtctctgtgactgcagggaggggccaggggagaggacagaaccaggtgacagtgaaagggagtggtgatatgtttatctgaaggcatctggaaggtgaaggagttttcaccactctgttcttgattttgtgtttttgttctgtttatgggaggatttctaaaaatttttttgtgacttgtggaggtcacatgatttaaacaacccatgctattgtgaaaagaaaacaaaaatttgatcatttctcatgtttgtagaatgtttattatacacctgtaattccagcgcttggggaggctgaggtgggcagatcacttcaggccaagagttcgagaccagcctgggcaacatggtgaaaccctgtctctacgaaatacaaatacatctcaaatacgtttctactaaatacaaaaattagctgggtgtggtggtgtgtgcctgtaattccagctacttgggaggctgaggcaggagaatcatttgagcccgggagatggaggttgcagtgagccgagattgtgccgctgtgctccagcctgggcaacagagcgagatgtctcaaaaaaaaaaaaaaaaggaatatttattataagctataagtttgcaaagaaagcattgttatttagatccaattttcctttttaaaaaaatatagtaaaaacatatgtaacacaaaatttaccatcgtaacctttttgtaagcatgcccttcattggcattaagtccattcacattgttgtacagtcctcaccaccagcatctccagaactttttcattttccaaaactgaagctcattaaatgccaactccgctccttctcagcctctggcaacatctgttctgtttctaggtaacttcatataagcaaagtcataaaatatttatcttcttgtttctggtttatttcacttagcataatgttttccagattcacgtgtattgtagcgttgtctgaatttcattcctttttaaggctgaatggtattccattccaaaagtgtgtccacattttgttgatccatttactcgtccgtggacatttgggttccttcccccttttgactgttgtactaataatgctgctatgaatgctgacgtgcaaatatctgttgaagttcctgctttcaattctttcggttatatatccagaaatgaaattgctagggtatgtggtaattttatgtttaatttttttgaggaactgccgtatggtaccacagtggccacaccattttacaatcccactggcagtgggtaaggaccccagttcctttacgtcctcgcaagatttgctactttctgtttttgttttgttttgtttttgatgaaagccatcgagatagatgtgaaatggtatctggtttccctttttaaatgagataaattaacaattgacatcttaaggtctgggaagggtcatttgtagcattacagtgctctttaaaatgaagaaacatgattaatatattcaactgtgttttccacgttgttactatttgctgacattatacaaaatatatctgggaacaagaaaatgtttgctttaactagagttcccaactgagaggatcactaaccctttccttaatggttgtcaagataaggtaaatgatgatagaaatgccccttaagagcttattaaaaagccagcagtgactttggccttgaagataaagcagagcacgatctgcaggaactggaatgcttccagagctccccttgataaatctttctttggtctggcttagttttgagaaagttacagctgaaaagtttgatcagggtagggattttgctgccgtcgttttggaattaatcatttgatccatctatcacctgataaaatccaaccaaggcacaaaactctactaacatgagaacattcttaaatagtgcaattagaagtctggtgggggtatgttttacctacatgatggaactcatttctaaaagtgtagaagaagtgcattgttagtagaagaagtgctagttattacataaacagttttagggttccttgctttttgttattgtattcctaataagtagaataaagtggcttgttaaaactcattgtatgttggtgtaaaagtagttctagcaggaagttatatggtctgatcaagaactctgtaaaactgtggagaggattagtgatgtggccacacaaagaaagacttaaaagactatgttttcttaatcagtaagtgtagttaagtcatcccccagaatctataagatagaatcaataacgctgttgatgttgattagctgcactctgctctaattgcaacatatcagaagtgcagctctacccagttctgtatttgaatcatatacaactcagtggtatttatatagtattttgcttattttaaaagaggagcattcattaaaaaaaatagttgaactgagattttcttttgctctcagagcaaattttccttcagtaaaacacagtcattcatcaccgctctctctaacaagggccgtttctgcaccgccagggaggcggcctcactgaccagaggagccaggaggggttgtagtttggaaactctcttgatgctggttaccttttctgcttcggtcctggcttcccattccctccataagccattttggcatcacctgggcctctctgaggagatgcgttcagtggggaactgaagggtgctttcagtgggtgtacagaaaccacccaggaggggctagctgtgtgagaatccctgggggaggaactcggacctaggcgggccggctatttagagatgggaccagaaggacctcatgaattaggcatcctgcagacagggtgaaattgcccagaggattgcttcacagctgccgaagcgaagaataagctgcatttcgtgatttcacctgagattggcagagtgtcgagttagtctaactcttcttaagccttggggtttattctccacatctgaatgtttcatgaaacaatatcgtttttccaaaatatgatacttcggctgtcagagatgtccttcatatgtgggggggatttttagtgcatgatgacttagtgcttatttgattcataaatcttaactctgtttcgcttcggcatttaagtagttgatacagtaaagccttgtctgtttccctggcttcatgtgacctgacagcttgctgaaagagtgactgcattgcactttgacaaaggcgccatccttcctgcactttaacccacctctaagcttgctcttgtattgcagccacctgagtgtcaggcgacttggctctgctagtcagggagggcagtggagcagttaagggtttggttgccggaggcaacttacttagctgatgaccttggacaaaatacttcgatgtgcctcagtttcttcaggtgggcattgagattacttaaaaaaaaaaaggcccatttctaatattcattttagggtgaaatgaataatgcacataaagtgttaagtgaagtggcatagtagcagtcacttaaatattatttctgtggtggcttcagggttttcctgggttaaaaaaaagggaaaaagaatgtctttctggaagcagagatggctgcaacagtgtgataggagcagccacctctgccacagtcccagcctacttagaggttgtgggctctgcctcagctgctgtgggaggggaggagccgtggctttgggcaggcgtggctgccgatgggcctcctggcctttcacaagtcacctggcttctctgggcatcagcaaatccatctgtaaaatgaaggcatggtttccaagtccctggctcagcagatttccctccctgccatccgtagtgatgtaggtgcctcgcacactgttctccagcccagagccttggccaagcctctgcctcagggccaccctggtaggatgagaagagagtgccaggtgggtgaggcaagagctgcccttggaagaaaaataacccatgctttttttttcttttcatggcagttgggtcagcatatcctttcattatcaaccgtctcatcatgtgtgacatttatctctggataccaagaaaaggcagtgcaggctctaagccgtatttgtgtggggaaggaacttcttgaaatatcgggttctaatgggtactaaaattatgtaatgactttatttttataacttttcctcaaaactctttgtaacattaattaaatgtaatgttaatgaagttattaataagcatgtggtggtataagaaaaattgttagccacatgcatcaattttccgtgatgggaacctggtatgcaagagaaatgtgggtcagttttccaacagaataggagttgttttttcctaagaaaaagttgtcaggtttacatatcaacacaagaatttatcattttctgaggagaaggttctgattacgtgaggtgttttaacatggagaaagtaatttggagccacacaaacctgaggtagagtccaaattattggtctgtggaatgacgtaagctctctgggtcttagttttcttagctgtaaactggggataatagcatcctcttcatcagattgttttgagaattaaatggtgcaagcttaatgcctattatacagtgtctagcacatcagagctcagaagatgatgacaaagataacagtgacactattatcgatgaaaatttccacgccaagcacagtggctcacgcctgtaatcccagcactttaggaggctgaggtgggcgtgttgcttgagctcaagagttcgagaccagcctgggcaacatggcgaaaccttgtcttttagtagactaaaaatacaaaaattagctgggcatggtggcatgcacctgtagtcccaggtactggggaggctgaagtgggaggattgcttgaccctgggaggttgaggctcgcataatcagtgagccgtgattgcaccactgcaatccagcctgggtgacagagtgggattccatgtcaaaaaaaaaaataaaatatttttttatttcctaaaaccttggaagtctgaagtggaagagaatgtgaaggggatgtgtgtggaagaggttaactccctatctcacaacttttatatagaattttttcatgcctctcttttttctcttaataggaatgaattcttccaaaacaaaactagaactgcaaaagcacctgacgacattaaccaatcaggagcaggcgactatttttgaagaggttcaggtacagtacagttgctaatttctagaaggaaagaaaaggcaggcagcttacctgggaaatgctatgtgtaaaaaatagcaaaccagtgttgtcccaacctgggggaaggtgccttgagttcgtcttggtttcaggggtgaccaatcttttggcttccctgggccacattggaagaagaaggattgtcctggaccacacataaaagacacgatagctgatgagctgctaaaaaaacaaacaaacaaacaaacaaaaaaaacagcaaaaaaaaaaatctcataatggtttttgtttgtttgtttttttgacagagtcttgctctgtttcccaggctggagtgcagtggcatgatctgggctccctgcagtctccgcctcccaggttcaagtgattcttctgcctcagcttcctgagtagctgggattacaggagcacgccaccacgcctggctaatttttgtatttttagtagagacaggctttcaccatgttggtcaggctgttctcgaactcctgacctcatgatctgcctgccttggcctcccaaagtgctgggattacaggcgtgagccaccacgcccagcccaaaatctcataatgctttaagaaagtttatgaatttgtgttgggctacattcagagccgccctgggccacatgttggacatgcttggcttaagctttcacagtctcatagagtgtccaggtcagaattgcagattcccatcaggccttagcttagatagtaaaactaaatgaaacaggcaagcctcttccttaaacaaatgttagaataagagagaagaaattataaaatggaaagcgcctcaggctgggagacagaaggtccggcctctggtccgcatgtactcatctgttccctgggaaacctctgcccgccccttcccgcttaggatttcagacctaagtgtgggagtcgaatgagacaatgtttggtacatgaacttgaacagaattccttctttcccccaacacctttttttttcatttttgaaaataaatttaggtcatgctgtctacttggaacctgataatatatcaaacctacaaaaacaaaacaaaattcaagctcatcagctttctgcaataaacttggaagctagctcttgcccttgcatttagatgcagtgtatctcggggagaccatgctgtgtgtgctggcatgcctgtagcctgttcattatgaatctttaatgaggtcatccaaaatttcatgtctgctttagctgaggggcattttcgatgattccctggcacttttttagggagggaagcatatcaaagaataaatatctccttttgaggggcgggcagcaggatctacaaatagaggagccattaaacaaaacaagacagctagcaactgggtgggtttaagtgcttttccttcctcactgggaaaagactatactaggatccacgatctgctttctgttagtgtaaaaaaaatgaaaggattgtctctctctctctttgttgtttttttgagacagagtctcgctctgttgcccagagccgaagtgcaatggtgcgatcttggctcactgcaacctctgcttcccgggttcaagcaattctcctgcctcagcctcccaagtagctgagatttcagccgcctgccaccaccacactgctaagttttgtattttcagtagagacggggtttcaccatattggccaggctggtctctaactcttgaccttgtgatttgcctgcttcagcctcccaaagtgctgggattacagctgtgagccaccacgcctggccgtctttctcattttaatcacgttagaggtcttgtcttattcccttgttctccttctacagtagaattggcatatgcttcaggaagagagcatagaaagatgttttttcatgtctcaaatagcctagagggtaattttcacaattttcatttgtctttgcattttcttgttttcttctgaatcaacttgagacatgctactttgttttttcttaaaagatctttagagttctaagtacacaatactcttagaaaatatactgtgatttgcatttggaattcaaaaatggacaatatgcttctgattgttaatgcatttacaattcaagttggggcctttttcatctaatgctggcccacttactgttctagagctgtcctgtcactttaagaaaccatctttctatcaagaatagaagaggaacttccctctcataatgtgggttttcttttttgtctagacagcaccacgtagctctccctaaaacagtgtgatgaatcagtataggtaatacacaaaatattcttccgcagcaatgagatgttcctaatggatatgattccaagattctctttgactcatgcaggcttttagacactgagtacatcatggtaaagacactttagaacagagtagattacgactaaggtttgctttagaaaaagagctttcagttaatatcctgtgtgttgttctagaggtctctgtaattgttaagctgctccagacaccaaagggaggttgtattcaccaactttgaaaagccggctctcgccttgtcttccatcactgtgagtgtggctgttccttgagtgatacagatttgtgcatggatcttttattctagaggcttgttagatggtcttgttgaattatgtcctcaatgaccattcttggttttataaaacattttataaaccaagtcattggtttcattttagacagcagtgccagctaatgtgcttgaaaatcatacatttcaaaaaggttgtaaggaaaaaggtggctttgcagtttcctgagtctccttataaaatagaatggtaaatattttcctttgttcagtctttcctggaggggaatttgtttcggaaaaagtcctctacatgcaaattttcataagggaaatgtaattaccgttgaaattaatggtacgtgattacttagttattaaaacataccttatttaaggatcatgtaaatgaatattaaatcaaaaaatggaactctaacagctataaagaaatcactaataactgtgtaaacgatgctggaggttatctctactgtaaacaagctaattttgagcactctgagaacttaatgccagatgggcatgtgggcataccacactgcaaagccatatttttatttatgagcgtttttgaaatgtttcattttcaaacatatctagctgggcatgtgttaggatgaccccatgatgctctgttactgggtgaatatactaaatccaaactgatcatctcaggataagaattgctgtgaagccaatgtggagctagtaaataaaatatctccaagtctaattctcctaatctatatgagtgtgtttcagggaatgacttaattaaatactgactagataaatcaagtagatttatactcagtagacattgataattcattaagtaacatgacttcacaagttaaaggttaatggtcagaagagactctttttactttctgaagaatatatatcagcttagttggattttgcatggttttaaaatgatgttagactgtagttttaagatgttagactgaaaactttaagttttaagatgttagactgtagtgtccaagtgagttttaagatgttagactgtagtgtccaagtgagtgttgtctttttaagtagttcccttaggagaccatgggctttctcaacattctgggatgcatcaatcagtgttggaaattgatttatttatttattaattttttttaagagaaaggggctcactctgttacccaggctggagcacagtggttattctagggtgtgatcagagcacatttcagttgcgaactcatgggctcaagcaatcgtcctacctcagcttcccaagtagctgggactgcaggtacatgccaccttgcccagctggcagtttatatctgaattgcgtttatgacaatttataagcctcttataggttaagaaacatgtaactaatttagttttgttacttttaacaggcgattaattattttgtaatattcttttataaattgaagtatgacatgcatatagaaaagcaaacaaatcaatgatgtataattcagtgaatttttataaggtatatacaactgtgcagccagtgccaagattaagaaatggagcatttctggccaggcgcggtggctcatgcctgtaattccagcactttgggaggccaaggcgggcggatcacccgaggtcaggagttcaagactagcctggccaacatggcgaaaccctgtctctatggcaaatacaaaaattagccaggcatggtggtgcgcacctgtagtctcagctactcgggaggctaaggcatgagaatcgcttgaacttgggaagcagaggttgcagtgagccaggattgtgccactgcactccagcctgggggatagagcgagatgctgtctcccccaaaaaaagaaagaaatggggcatttccattgcctcatagtcctgttttgtgtctgcctccaggtaaccatcatcctgacttctgacatcatagtttaattttgaacaagcaagtaatttttgatggcacagtgatgttacccaattcgattccccattattttcctaagacttatctctctgactaatgaatgttcataaagttaaatcacctttaagaaataatgatttggcccagagcagtggctcacgcctgtaatcccagcactttgggaggcagaggtgggtggatcacgaggtcaggagatcaagaccatcctggctaacacggtgaaaccctgtctctactaaaaatacaaaaaaattagctgggtgtgatggcgggtgcctgtagtcccaactatttgggaggctgaggcaggagaatggcgtgaacctgggaggtggagcttgcagtgagcccagattgtgccactgcactccagctccagcctgggtgaaagagcaagactccatctcaaaaaaaaaaaaaaaaagaaagaaagaattaatgatttgctactatcgaggatggtgaagttgcatgggagattttagggaggtgacacctcactaattgtatttcagaattacattaaggaaagatttgtttcttgattgtgtataacaccatcgacgtttatttctctgctttagtgacttctgtatgatgtttaacaagctccatgacgcagtctctgattcttaatcagtttttaatgaaaaacaactgtggtagtatactgttcccagttggtctaatttccttcttttaaaagtgtattttgaggggaaaaatatattaatactcctcctcttactatatgattagccctttaaaatattttgaaatagatgatgatgaagaatttctccaagcacaatatacattttcttgtggagatagccagaaggtttaattaaagacacaggagaagaaagagtgggccaaccatcaggcgcctgtacctgctcagaggcctcataattcctgtctgtttccctggatcattttttttttaatagacttaattttttttagagcagttttaggtttacaggaaaattgggtgaaaagtacagagttcccgtattagctttcactgtcccccaccccacagtttctccgatttttaacatatcttgcattactgagggtttcttcattataattgatgagccaatatttgtacattgatattaactaaagttcatggtttacatttgggttcactgttggtgttctgtattctgtgggttgtgacagatgcttaatgtcatgtgcccatcattacggtatcatacagaatagtttcactgccctaaaaatccccgtgttctgcctgttctcccacctcctccctaatccttgatctttttgctctctccatagttttgccttttccagcatgtcatgtagttggaatcacacagtagccttttcagactggcttcttttgcttagcaatatgcacttaaggttcttccatgtctctttatggcttgatagcttatttctcattgctgaataatactcagttttatagatgcactacagtttctttacccatttgccgatcgatgcacatcttagttgcttccaagttttgataattgtgaataaagatgctgttttcagctcatttgggtaaacaccaaggagtgcaattgctgggttatgtggtaagaatgtgtttagttttacaagaaactgctggcctgttttccaaagtggctgtactgttttgcatccccgccaaccataaatgggagttcttgttgttttgtggacatttgggctcagtgtacccataaccctttgatctagcagtgttaagttgggattgtggcattactgccactttcctttttgagaatctaatgcccactttctccagagaaatccactttttgcatataacttgtaaaattttgtaatattggggttcacagcctggagtccaggttgagagtgtctgctgtagcctccaaaatatttaatatttcagtccgaaatttgaaagaacaggaaggcctcaatgaaaacaaacccttctaatcattaactatcctttccttaagtaacaagaacaacttacctttaatctttttcgttaagaaaggactgggtttctttaagaaaggactgtcagaaagtctgggttagtgttacctttgctttgaatgcttattatgtgcagggtaaagttgcttccttagttagctggggaagaagtgaccaagagtggtgttgacccagattcagatccttgtgtagttgatccatttatgtcactgaatttgttttaaagaacagtctggaaatttggagtagggagaggggaggaacaggcaatggatacttgtcaacataaaaaaagatgtattttcaaaatttatagactaaaaactttgtgtatcccaaaacaattcattttactttcttcatatatgataaaatcatacattaaattaggtggactttaaaaaaattcactctggcatttcaaatccaaagcatttgggagcaggaggagaccatagagtttcctctgtgcaccatcctcacttcagcagacagggaagctagaattaaggggcttggcttcacacttctcggcagcagccggaacctacatgtcctgacttctggtccagtgtgctgtgccacgaccctgtctaaaagttaaaaggcatagagagaattttttttttaaagaaagaagaaagaaatgtacatgccatgaagttttgtatggaagggggtgccccatggggattccacagagtgcttcacggtgaacacattcgacataggaaattatgacactgaatcccgttgctgttttccttgcccgttccctaagagtttgtcaatgtttggtcatcatggcccctgacctttgggtatttatatggattttgtgtttttcctcttgttttaaaaactatttatttgttaaacattttgactgtgtctctatctgatattaaagattcatttttagatgggaggacatcagagatgaaaagctaaatctggcccactggctccactgttcctttttaaaaattctctctacttttaggatcattggtgccccctggtgagatgattgagtaaaagcactagtttagtggatggaagctgttagcatttaaaaagacggcttagcaatattgttgacgattaaaaataaatcctgtttctgatttttgttttaaagaaattgagaccgagaaatgagcagcgagagaatgaattgattatttcttttctgagatgtttatatgaagagaaacagaaagaacacatccatattggggagatgaagcaggtatggcatttttgtctcttgtaattgttgccaagtctctgccaagtctctgtataaacaacgttttgaggattttctgaaactctgatacctttttttctccctatgttttattttcctttgttgcacatagaggggaaatttgggagtgttagactatgtatgcttgagaagataagaaaagtttctgcctgcaccatagtggaggcagaacagttgctctaataagaggactggcttagagcagcaagaattgagtgtaagagtggatgccaccaagatgagctgcttggcttgcagggagctggtttgtcacctcgcctttcttctttgtaaacctggaaggacattgcatggctgcctttggaattacaaaaagtacctgaacgtcctttgtgatataaatgctaggtcacaaatcagatacaatgttggcaagcctgacttatgtgctattcaggttagaacttggattaattccattttgcatggtggaaatacagagtctccctcccctcctccactgtctacagccttatttagcttttctctttgtggggtctcaaggcagaagctggggctctctgcagatctctcccttggaagatcttcaggtttgggagtccctatgttacatggtaccacagaccatttcctttgtcttttggactccatgtgagtccattcataatgaaccattaatagcttcaaaacatacacattttatatttgctaaagttacctgttggccagaaatctagagaaaaatcagtgaaggatgtacaagtttctcagtttcccaaaagtatgttccctttttctttttgaacactccccacgtacgtgttccaaagacacttgtgtgctcagtggtgtgccctgtcctacggcagcctttgcgtctggaccctaaaccaagtgtgcagttttcatggggtgtacacttagcaaatctccacataaggtttctaccttctaggtggctttggcagtcacgtgccttccctgaacacttgggctggtgtacagtgtcagccacggtttctaatctcattggccagccatgaggtcctttagcagtgactctaacatgagtatatgacctgtgttttttggggttttgacttgtggtcttggtttgtagccattcctcccttcccaacctgtacccttaagatagcattcaagttctgtgtctctcctgttcatttttggatggaccagttggtctaagttttcagttaattctggagttcatttttcagcctatttcttttctcttttccactccctttttcccctcttgtgccactgatagctttttccctgttctgattttcttttatctgagtcagtctgacttgttccaacaggaaattgataattttgaagtaatttataactgctagaaaggggaatgaagcatttacggtggatggaaagtcttcttttactaaacattttgagcatttatggtgaatggaaagttttgacctaactgcagactcatttttatggaccagcataatatttttatgatttgggcatagatcatccaatggagaaatgtgtttaatgttttttttttacccaaaaaaacataagagttcaatgtagaagtgactgagccttacaagcagaactggcatctgtgtaacacttttactaggggtttctaaacatcatgaaccagacggctcatgtcttcgtctataaagaagctgccctaatcccctgatgaggttggtgtactccaggctggacactctcatgggctctgaggagtgggtttttcagagcagcagctgctttatagacccattaggcacagccttgagattcactgatagatccttttcatgttttctgctatcagtttagccacgtggatttcattaccttcttgttgcacctaaaaatttctaaagcttttgaaaatgtgggaagatgtgacatagaccgtggtaggatcatggctttgacaaagaacttctctggccacaggacttcagaagcggacagaggacagtgagcgcttctctcagtgctgtgcgtgtcagggtcggcagggaggccatatgcgcttttcaaagaccaaaagaatagtgctggagaactgtcagaggagttgtgaaatagaaaaaaccctgaatgagtcttttgatcttatagaacagggttcagtttgggcaagacttatacattaagttagaggctgtcacgttttagtcaatggacttgtcgtttccacctgtattcacagaggtggtacaaaaattagtatgaaatcagctgccacttactgaatgtttgccaagtgccagatagagttctcattccttacataaatgactccattcattctacaagttttttgaggtaggtggtaaaatacccattttatagatgaggaaatggggaagagcagtcaagcagttactagtgagtagtggagccactttgtctgatgtctaagtactttatcttaattattgtgtgtttttttaaggagcttaacaaaatttaatgctatataactacttactgattttcttgggtctgttttctagtagataagattttctttctttttttgtgacattttattatgaaaaatttcaaacatatagaaaagttgaaagaattataccatgagcactcatatacccaccatccagattttacagttttaaagactttgttaatttgctttatcatatatttatctattagtccaccttatttttgcatgcctttcaaattaggtgatatcagtacccttcatccctaaacactttagcatgtatatcattaactagaatttagtgtttgcttccaattttggggagattaaatttacatatggtaggttatgcaaatcttaagtgtaccatttgttgagttttgaccactgctgctacattcaggtagctcaaacccctatcaagatatagaatattttcatcctgccgggcgcagtggctcacgcctgtaatcccagtactttgggaggctgaggtgggcggatcatgaggtcaggagattgagaccatcctggctaacacagtgaaagctcgtctccactaaaaatacaaaaattagtcaggtgtggtggcgggtgcctgtagtcccagctactagggaggctgaggcaggagaatggcatgaacccgggaagcggaggttgcagtgagccgaggtcgcaccactgcactccagcctgggcgacagagagagactccctctcgggaaaaaaaaaaaaatttcatcctaccagaaagtagccctatattcgtcttctagtcagtcctcactaccccttcccccaggtaaccactgttttgatttttttcaccttagattagttttgcctgttctggaatttcttataaatggcatcatactctttttttttttttttttttttttttttttttgagacagagtctcactctgtcacccaggctggagtgcagtggcgctatcttggctcactgcaagccccgcctcccaagttcacgccattctcctgcctcagcctcctgagtagctgggactacaggtgcctgccaccactcccagctaattgtttatatttttagtagagacggggtttcaccgtgttagccgtgatggtctcgatctcctgaccttgtgatctgcccacctcggccttccaaagtgctgggattacaggtgtgagccaccgcgcctggccggcatcatactctttgagttctggctccttccacttagcataacgtttctgagactcatcagaaacgttatgctacattgttgcatgtattagtagtttgttgttgcatgtatcagttgcttgtatcagtagtttgttcctttttgttctgtggtattaatgtcaagagtttctttctccattctccttctgagctgcttgattatgaataaggctgctggtagatacattgtgccagcctgggatggtgagttctgaactgagaatttcagtatagcatcaggatttaaagcttgaatacttgaatccaaactttcatgcttagagtttaccccatctgttgaaggatgtgcaatataatgactgcaatagaattcactgtggagcctccaaattagaaattattgtctgtgagggccaggcacggtggctcacgcctgtaatcctagcactttgggaggctgagatgggaggattgtttgaggccaggagtttgagaccagcttggtcaatatagcgagacccccatctctgttttttttttttaaagaaattattgtctaagaaccagtgtcatcttccaaggagaaacttctagatacttgttttaagataaataagaaacaagtcatttctaaatgtgaattattttttaaatgcaattttttaaacattttattttaattatggcaatagacgtggaaaagactcttttttgatagtaggggagagcagaagaaacattgaattaagtacacagagattcttcagacctgctttaaaaacacatgcatacaaatgcacttctgtctcttaggatctactaactgatgctgcttgctttagtcttttagctaatattttctttctttctttctttcttttttgttggagacagagtctcgctctgtcgccaggctagagtgcagcggcacaatcttggctcactgcaacctccgcctcccgggttcaagcgattctcctgcctcagcctcctgagtagctgggactataggcgtgcgccaccacgcccagctaatttttgtatatttagtagagacggggtttcactgtgttggatgggatgttctccgtctcttgtcctcgtgatccgcctgccttggcctcctaaagtgctgggattacaggcgtgagccactgcgcctggctcatattttctttatatatcaaaacaattcagcttgcttcacttttatgaaagctttattatgagtttgaaagcaattctgcattttcttaacattgtaactggtgttgagttgaaggcaggcccctgggagccctttgtgggcaattcccttcactctggaggctgcctcgagcctggacaggcacttacacttggtcagtgattgcacagaaccggttgcaacagattctgtgcacctccctgtggcgcgtagcatttagcaggcacttggtcactatttgctgagtgagtctgttaccttaggcgtgtatttcccgtggacctgcctggggatcattgctcattcactcattttgaacaagccaatattacatgtccagggtacgctctatagtgtgaaacacaaaggtaaatgatagttccccttctcaaaggaatttctaaggtagtagccattcttttgatgcatattctcattctcatagagagtccaattatggataattggacaaagctgaatgtcgcttttatgagaatccattctttctcttttatgctttgaaaaatgtgtagcattcattagtgaattaggatttcattattcaaagaagacataaggtcttcgaacagcagatgactgaataaaataatacctaacagcagtagaatgaggggaggacatattcaaggaacattttatgcccattagattggcagaaatttttaaaaagtgacaataccgtataaaggtgaactttcctatactgatactgggaacatgaatttgtaccattcagggaagagaaacttgataatatctggtgtagtctgaaggggcacagtccctgtgacccagtgaggacattcctcattatttcccttgccaaacatttcacatgagtctataaggagctctatataagagaggtcactgcagcctcctttgtaagagcaagaaaaaaaagcaaataagtgtttaacaataggaacatagataaattaggttatgcagtgaatatttgcactctgactaaagtgagtgaatcaaaaaaaatttgtcaacaggaataaatctcaaaaataatattgaaagaagaaagctaatttacagaaggatgtgtacagtatgacaccattcatttagtttcaactacatatcttttatggacacatacatataaaagcagaaaacatgaattgataggataaacaccaaatatttctgcatatggccaggtgtggggaagtagtggtgattaagcttcaaagatgtctgcagtggttcccattaaaagtagaaagtaggctgggcacagtggctcacgcctgtaatcccagcactttgggaggccaaggcaggtggatcatttaaggccaggagttcgagaacagcctggtcaacatggcgaaaccccatctctacaaaaaaaatacaaaaattagccagatgtggtggcgcacacttgtagtcccagctactcgggaggctgaggcatgagaatcacttgagcccaggaggtagaggttgcagtaagccaagatcgtaccactgcactccagcctgggtgacagagtgagactccatcccaaaaaacaagcaaacaaaaaaagctcatagagtaggtaatagtcatgatatctgatgttttttgattgtctggtttacattttttatttttattttttgagacaagtctcacgctgtcacccaagctggagtgcggtggtgcgatgtcagctcactgcaatctctgcctcctgggttcgagcgattctcctgcctcagcctcccaagtagctgggattacaggcgtgcaccaccacacctggctaatttttatatttttaatagagacagggtttcaccatgttggccaggctggtctcgaactcctgacctcaagtgattcatctgcctcagcctcccaaagttctgggattacaggcatcagccactgcacctggccttggtatatgtgttttaatttgtattcattcatttaagcctcatgacagctctgcgaggaaagttcactatacgtcttcaggctgcaggtagaggacctgaaagggacaggaggtaacagtctggccaagaccacagagccagggaatagcagaggaacatttcacctgggcattgcactccagagctgggcttctcactgttctcaacccctggcaaatgctcacttgaacaaagccaggtggtgatacaaaggtatttgttatattagtctctacacttttctgtgtgcttgaaataactgcaacaaagaatatatcagtatttagagtaatgggggatttgcttgtgtgtgtttgtatttttgagatggagtctcgctctgtcgcccaggctggagtgcagtagcatgatcttggctcactgcaacctccggcttctgagttcaagcgattctcctgcctcagcctcctgagtaactgggattacaggtgtgcgccactacacccggctgttttttgtatttttagtagagacagggtttccccgtgttggccaggctgatctcaaactcccgacctcaggtggtccacccaccttggcctcccaaagtgctgagattacaggcatgagccactgcgcctggccgtttttttttctaacgaaattattttctaacagaaagcaatcaggtgagaatccacataagaaacaatttaattcagagatttttgttgcatattaaaaaaaaaatgtaccttcggctgggtgtggtagctcactcctgtaatcccagcactttgggaggctgaggcaggtagatcacttgagctcaggagtttgagatcagcctggccaacatggtgaaaccccgtctctacaaaaactacaaaaaattagctgtgtgtagtcccagctactctgggggccgagggagaaggattgcttgaacctgggaggtcaagactgcagtgagccatgattgtggccctgtactccagcctgggcaacaaagtgagaccctggcaccctgtctcaaaaaaaaaaaaaagtacctccttgtaaataagtaacactaagacttcatttagtggttgtcaagcaaactccattgtatttttattttcagtttttatggctagtagttaagggagagaagcttggttgcagagaagaatgaaaggatgatgggaaaataaaagtaggagagaggaaaacgcaagaaagcaagagatctgtagaaagggatgaaggaattgtataggcagagagaataggttctttaattgagaaatttatgttgtctcaccttctgaaatgcccccaaaggtaagttattgttttattttgaaaagctaatgatagctacctttctaccacgctgtgttcaatgttttacacactttacctgtttgagtctcacaacacagtgttatgattcgatcttgccattggtctcactttactgaagaggaagtttgaggctcagaaaagtaagaaactggccgaagaccacggttagtgaagacagatctctgatccagttgcagagtctgagcaataaactacttcaactgattggtttcaaagcacatttcgtcattttacttggggtaatcaaagcaactctctgaggcaaaattatttcctggacttgcagccatgtcactaaggagcagatgaggtgagatcacagacaggatcagaatgatggcctggtgccaaaaagatgtgtcctagagatttttcattcctttaagaagcagagaagggagcgataaatgacttttcgtttttcacttttttagacatcgcagatggcagcagagaatattggaagtgaattaccacccagtgccactcgatttaggctagatatgctgaaaaacaaagcaaagagatctttaacagagtctttagaaagtattttgtcccgggtaagtagcataatttctcctgatttaagttaaatcactttttaggagagtgtaagattgagttctatgcttttattccatcaatgttcatcataaaggtaaaagtataaaacctttttttatgttttctcaggcttataacagtattatctacattttaaattgtttttaatttggcctaggtttaaaaaaaatattccttactcttttgtattatatccaatgggatttttttgccgctccaaagaatatttgttagccagtccctataaagagcatgcattagatacactgaagtgtggcttctgttctccctactatcactatgtataacttaaaaaacagttactgtcagctgctggtgttagctatctaaaaggctatatagtaggggtcagcaaactatgcccatgggccaaattctacccacctcctatttttgtaaataaagttttgttgaaacaccgccacatccattcattttccagttatctaaggcttcttttttgcagacttcagcagttgccacaaacactatatgcctcacaaagcataagacacttactatctggccctttacagaaaaagtttgccaaatatagctctatagaaagaacaaagtacacatgtacatcaatctgggagttctttaagaaattatccctccctcccatgagtgtaaatagcctgatggcacgtctgagaaatcaaatctgattttccctcagagtttcacacctttctggagtgtgcagtatcttattatagttctttttgattttatggcacacttcttttgaaacatctgattttattttattttttaattaaggaaagttaaattttattttcttcgaagatgtttctgagaattttgcaatatcttctgagatcatgaaaaacagttgatttacaaaaccagagttgggaggggctgcatttgagagctcccaaagggatagagtgctgtccgagtgacatgcggctggccgttatgatgacttgtgacccaggggagggagttagttgctgagtgggcttgagcacttgattttccttatagacgaattgtcttgtcttcctgcctatcactcatgccaaattacttagccaccaggtgttttggaacgtttaggttagtgtcttatttattttttaaaaaaatgatggaaatgttgattattttaatgtacaaatatccttagtagcatttctcagtagataacatttttttcctgagcttatttaaatggaccaatctgcttctagctgatgcctttgcaaaagcctccagagtcataactcgactgccttttctttatgtagggtaataaagccagaggcctgcaggaacactccatcagtgtggatctggatagctccctgtctagtacattaagtaacaccagcaaagtaagcacatttctctttatacgacaccctgaagaaaccaacaaataggtcttgctcatctcctgtctacatacctccaatcataaaacgtttgctgcttgcaaatttcttggcacaggtggaggactggtcatgcagttctatcataacataaaagttttacataaaagagcagatggggctgggtgcagtggctcaacgcctgtaatctcagcactttgagaggcggacgcgggcggatcatgaggtcaggagatcgagacgctcctggctagcacagtgaaaccccgtctctactaaaaatacaaaaaattaaaaattagccgggcgtggtggcgggcacccgtagtcccagctactcgggaggctgaggcaggagaatggcatgaacctgggaggcggagcttgcagtgagccaagatcacgccactgcactccagcctgtgtgacagagagagactctgtgtaaaaaaaaaaaagcagtagattttcctattaaaaaaataattaatattgggaaaacatcagaaagtggatttgtgaatttagagaagtatacagcttaaatttttctttttttaagaaaattttattttggatttgggggtacatgtgcatgtttattacatgggtatattgcatactggtggggattgggcttctagtgtacccatcacccaaatagtgaacattgtacccagtaggtaatttttcaaccttcacaccccctttcattctcccccacttgtggggaaattaaatttctgaaactttatcctgtagctggctctatgattataatgaaacattactgttttatttaaataagcaagtatctatgtccttcttttaataacttgctttctagacatttaatcatatttaagcctggtcagttcaactttataactcctgaaaagtgggtttgggttttgtgctagggaggccagctttcccttctgctaccagaggactctctttggcagtagtgagggagggagtgtttgtggaggccagctccttaccacaggcagggtttacagtcctctgccatccctcctagacatatggctttcagaatttttctaacctacagtaagaagcacatttaacattgtggcgtagttcacaaacacacatacctacacattcacacacaaaattaaaagttcacaaaacaatatttactgtgaacaacatacaatacatactgatattttgttctattttatttttaaaatgctcatggcaaactactcagttgtaccacctactaacatgatagagggagcagtttgagaaacacttccttagatggatgagtgcttctcaaatttcaggtgctccgcctcccgggttcaggccattctcttgcctcagcctcctgagtagctgagactggttaaagtgcagattctggttcagtaggcagggtggggggagccctgaaatgctgcatttctgacaagctccaaggcaatgctgctgctcctggtctgcagaccgcctctggggagtgaggtcctagacagcagtcttgtaaatgtgagtttctgagttaaaatccaggggaacatagtgtcgtccagcctccatctaatacacactgatcccaccctgcaattcattgcaagtgtgggaaggctatttgcttatttgttgtgtacagatgaaccacacaccgcccctttcatgtaggaagttacctaggaggagagagatgacagatacagaaacagccccagcatcaagcagagtgtggtaggagcccagaagttacaaataagagacattggtaacttcagtgtcagaagagcaaggggaagggaagttaggtttggtcagtggaaccagggaaaaggtgaggggtgagggggcagtgatgcttttggactaaatcttggtgtaggaattgtgcctatggaagtgaacagagaagaaggcattctagacagaccagtgtcaatagacataccatgaagacattcatgtcactcagtgggctttccagtaagccttattgcttgctttttatttttctccaaaaggcagatctaggaatatatacatattcattcttcaggactcgatagttgtgaagattcttttaaaaggatttaaaagtctgtctaagattgcaatttctagagtcattctaagagagatgcaacttttcagaagctgcttgtatgtattgtatatgtttaagtgtactttacatctttcttttattcatcttgaattgagaaactactatattctattttatgtaattggatcccttctaaaaaattgatcacctaggagttgcaaagaaaccaaatagccctgaaacttgacaaatgaaaatggccctttcagttgtccaattaagctaagggttagctctttgatatgatttggagggatattagtaagaatttagatcaacaggtttgcatgatggagattgtgttctgtgatgtattgtcttagagagacttttaaatccttaaaagaatcttcacaactgttgagtcctgaagaatgaaaaacttcagttatgaaagtaatcaatatttcatagtatgttgggaattttttcctaattcttatacaattaaatgtatgtaacttctccctttggtaaacacatttctttttttttttttttcaaattaaaaccctcaatacttgttacctaaaaggcactcaactgtgtaaatgaacaggtagaattcagtctccagtccactgttagatgcattcattcttgtttactctattcctgttgatttattttttctcttccaacaatttcaataggagcaagctgctacaattcctctttttgaatattttgaatatattaaaaatatattggccactagccacgtcctgggtgcagtgttaaacatcagtttgcttgagtggtagtagttcattcctttgaaaaagcgtgcatcgtgaaggcatacaactttaaaatattgtcatgattctcaacaaatgtttgagcactcactccatagatttattgcatacctaataaaacaataacttatgtttgtgtaacattttacaacataaaaagtacttttggttgtatcatcttgctttgttcttgaaactcagatacatttttactttaccctcttacagaagaaattgaggtgcagaaagaaattatttgccctgaattgcagcagtaagtgcctacagagtgattttccatattctaagaatattgatacagttcttaatctcaaattatgaagtcgaatctcaacagtagatcagattcggagagagccttaaaatgtgggtttaacatgagtgaacacatgtggcaaagataaagaacttggttaagcagtggagacaagttctccagcactcacaccccttagaagctgcagtaaacagtcctgttttctagagagagggcactattcatggcgttgttcagaacgttacagattgtggcttatgtccttcactcctgcacttggccagtctccccatttctccagcaagccagcagtgtgtccttgaggagcgggcatttatttaatggaccttcattttcttctgcttttggtggtggcttctagatggcattataatcagaacacatacttagatactgcaatgtttgcccgtgcaggaactagagatttataaatcccacatattccccatggtgtgtctgatctgctgtgtgtttgctcccaggagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaagtaagatttgtttaaatttgttgcataaatagctggggcatatctgtgactagccaggtatgtgcatcccaggtatgtttattgagtgagagaaatgagtcaggctttactcttggtttggagataaaactggaagcagtgacatgttcgttcgagctgcttgtgagtatacaagcaatgggtacttgtattgtcaggaagcaagtgaaagtgagcaaaaatggtacctaacatgcatagtcattactcctcaaacaaagtaagagacgttgttgactgtggaactttgctgctgtgaggaagagggcaagcggatgagtctccccatctgaagccctggagcagggttataatgggagggagaggcgctgatccttacaggcagagcaagagaggtatgctggcctcatagggtgacaggggtgcttcagcttctggtcctagctctgccgtgaactaattgtgacctggacgaatttgctaaattctctgaataacaaaattggagtagatgttttctaaaatctctcactgtaagaattctagattcttctaacaagatttattcattgtaatagttgggttcctgtgaccagttagaatcgtctggttatggagaagagtaatcagaagttccccccattccttccaagtgtcccttagtgattcatttaactctgtgtgccagagactataaatggacacagttatctttaaaaacaactttaaacaattttaaaaatctctcacctaatatgaatcaaggtcacacctgtgtacagtcgctgccttcttctgaccagcagccgcagaagtcccaggacctatgtgttcgtgtagttcatacacggatcattgagagtgtgagttagtacagaagtgtttggaatgttctgagtaaagaagtgtgagcattaacagtcctggatgatggagcagagcctcccagctttgttttctgtcagccattggaaagagttcttggttctttggaattcagcggggtagtggtgatcccaaaagcaggggacatgtcagaaggtactgcttaataaatacacgcttttagagacacacatcgttgggttgtagctgtgtaagtttcttgtgtttaacaccctgtctgcacattacttctgtgctgcctcaccactgcctgcccactcctctgttgttggcgttttcagtgatcattgaaacattcctgtctggagagtcctagttctcttgtgaagtctgctgtttctcaaaagccagagttgataggacttagtatcagtacttttcctttctccatgaagaatgtagctttataatagatgatgtcacacatccgtaatgggagggatgaggagatgcctgtctgtctgcctctctagcatggcccattctgctttctttcccccttgtgagctcttttccgatttatctacaggaaataagacattgaaattcagggcaggatattgttcattttaaagggaaatgtattttttaaagttcagtttttttttgcttttgtttatactttaattaaaaattttttttcctgccagttcctgaaaaagaaaatagagaaagaaatattattgttcctgggcgaagtggctcactcctgtaatcccagagctttgggagactgaggtgggaggttgcttgaggccaagagttcaaggtcacagtcagctgtgatcgtgctaccgcactccagcctgggtgatagagtgagacctattaaaaaaaaaaagtattgttgggagcataaacacgtgggaaatggtcaagaacggccgtcaatatactctgtttttcactgaaaactacctttgccagagagcgagcagagatgaggaaaaggagtggaagaagtcctccactctgatagtgttactggaacaacgagacaaaagcggtgtgctccttccacctgtttgctccgtgtccctgtcggcgccccctctcctgctaacccccccgtgctttctctgattgctgtttagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagaggtgagcacactcacgtggcaagtttggtgttgtctgttttcctggggagttcacactgatgaggatgtgctgaatggggggaatgtccatgcaggaagcagagccactgtgtgtgtgtgtgtgtgtgtgtgtgtgcgcgcgcgtgtgtgtctttgtttatattttgtcttattttcagctgtcatttgaaccaagttaattttactattgatgacttttcttaagattattatgaaaacagatcttaatggcagattggtttgtgtttgtgtttgttttttttttttttgagacagggtctcactctgttccccaggctggagtgcagtggcgtgatctcggctcactgcagcttctgccttgtgggttcaagcagttctcctgcctcagcctcccgagtagctgggactacaggcacacgccaccatgcccggctaatatttttatttttttttgtagagatggggtttcaccatgttgaccaggttgttcttgaactcctaacctcaagtgatccgcctgcctcagtctcccaaagtgctgggattacaggtgtgagccactgcaccctgctgcaaattgtttttttatacttattttcacatttccttgccctagtggacacttacatgcatgcgtatatacacacacacgcgcgcgcgcgcgcgcacacacacacacacacacacacacacacacacacaggataacatctgtgtttgatcatgtacactgcaatttgtgccatatcagaaacttcctgattgatttaggggaattatttttcccagtttgaaaggaagagttatttggaaaatggatggattttcttttttaaaaaattattgatcccattcatttaaaatcaaattttattggtgaaaatgaaaattaaatctcattcgtgaactacttttaatttcttacctagttttcttttcttagcattagaacaaaaatgtttcttttattttgaagcttatattttatactttgtgtttttatgtttctttatcctaaactcttttttcaaccaaactcttagcatctcctaccgtaatgccctgcggaaaaaacttcattcttcttcctctgtgccaaattttctaaaatttctggctcctgtagatgaaaataacacctctgattttatgaacacaaaaaggtagggcttaatttagatatatcaagcctgggtgttactaagtgttgaatatcattagatatacaagggtgttttaattactattttgccatttaaaaaatcatttcagctaaatctgttgtatcttctttcttatacttttttcttactgaatgccatttttaaaaatgtgcaaccaacctgttctctagttttgacgaggattagtttaagtgttatcttaagaaaagtctttgccaagtctctgagaccagtgtttctggttagtgagcatatgtctgtttcaaatcaggatgtctgatctgttcaggacgtctaatctgtaagttgaggggattgcttacttacaggtacataacttgggtataaattggaagggccttctcaggttgtcctgtgaataggagaaaacatttatgattgtgtttatatattgataactgtattttgtagtttaaaaaatacacacgttaaaacaattatcatcatcaagtgactgcatagttattgccttgctggttctgtgtaattaaattgcaagttttttcattttttgtgggaatccttggagacatgggcctgtgctgagcagatattcccatgcacagaagagggcagaatggggccccttggcatcaccccctttccccctttaggcagtttctctttatcaaagtggcaccaagagaggcccaattggaactatgatatgtggaacatgtttcttaatctctgttacaatcgaaatcacttaagggcatgtaatctttctcttttcatgaaaagaattctgtaagaaagcagttctttaggaatgatgacccactgtgagcttgatataacttctgtgattgattatttgtttatacaaagatagttgataatttagtgatttgtttaaaaaaatgttaagctaacaaaatcccgtgaattcctccccactagtcataaatcaatcatcttataattttagggactttgaatccaaagcaaaccatcttggtgattctggtgggactcctgtgaagacccggaggcattcctggaggcagcagatattcctccgagtagccaccccgcagaaggcgtgcgattcttccagcagatatgaaggtaaggccggtacctgaaatgaaacctcaaagagagcacgctgacagaggaccctgggagccccatcatattggtaagaaagcagagcgccgtcctcttcagtattggcaggtctgaggcaatcacaaaggtaactagggagggaatttagaggttaccctccatttcttagggaaggaatttaaagctaatttagggtaacctctccataaacaggagcagagctctgatgtttagagtggtcacagtgttaaccagcggtgaatccagacaggtctgcggcaacctcacttcttgcctcctaggacataaggcaaaaggagagactgaggcaagttttagagcagcagtgaaagtttattaaaaacttcagagcaggaatgaaaggacgtcaagtacactttgaaggtggttaggcgggcaacttgagagatgaagtgtgagatttggccttttgacctggggttttatatgctgccatacttccggggtcttgcgttccttcttctctgattcttcccttggggtgggctgtccgcatgtgcattggcgtgctagcacacgggggttgtgggggagcgtgcgcagggtgtttactggagttgtaggcgtgctcacttgaggcgttcttccctgtccagtctagcattcctagaggaacgtcatgcaccaggtaaattccgccatgttgcctcttaatgcgcatgcttgagcccactcgcccagctcccgagatcttattgggaagctgcagctccccagttttaggtgttttctatctactgggagcccgcccttccttggtgcccgctgtgaccaacgatcactttagagaaacagttgacaactgcctgaccaacacctgatggtcgcctgacattgctggtgcatatctggaaagggccctctcctgccgtcctcatgtctgacgagctacccgctgtaaccaaagcgtgggcttcggagtctgctttcaaatcccagcttttccccttaggagctgtgaactagaataaactgtctaaagttaccacctataacctgggattaattatgcctgttgccacactgatagagacaaggcagcatgatatcattactgatacattttttttaaagcattcaaaattcatagtactggaaagaaaatcagtgatgcgaatgtttccagggtaatgtcacctcccatgctgtggaagtccttcgggtgagcctggccccttgcttcttttgccccagcctttctatgtgggggcaccatggagctgccactcaccagcaccttttttccctcaagtagtttgtacctataaagtattcctgccgtgggtggcccctcggtggagctgctgagcctagccagggtttgatttctcttcctgccagtgtgagccagatggccacatctctcttcccctgccccgtggagaggtctgcttaccgcaaagaagggctcttcctcccaggtcctgtagcaccctgttagagggtgtggagtggagcagtgggaaccagagccaccagagggaggccctggaggaggaacgaagctgattcatgtctgaaaggggtgccagaacccaagtttcggtgtttaataaagagtgcctcggtgttgcggtggccatacctcacagggcatggtcgcttggaaatttctgctcggaaatgctttgtgcagtggccaggatgcgttaggggccacagatgactgcttgctccatcatagaacagttccaagttttcaaacgagcattcacagactgagccgcatcctgcctccctgtcctctgattcctggcttcttctctggtctctgaagccacacggaaatgtgtttgcatctgtttcctgcccttcagatgacagaggaccatggaagctgctgcctcctttagctctcttctccaggggaattgccctcgtcactgtttgggaacccctggtccgagtcctgtcctccgaagagcctctgcccctcctggagtcctgagttgaacttggtgttcacttggcctctggctctggcagtgtgttgctccttccgttgacctgccactgctctgttaatgcagattgatcttcataatctgtttctgctttaagtgattaactcaaacattcttggctcttattctatcttgtcctttgggatatgaaccattatttaaatttggactggtttcctggcttggcacagttgaccatgcctgtaagctcagtgctttgggaggccaaggcaggaggatccctggaggccaggagttcgaggccacccttggcaacatagtgagaccctgtctctacaaaaaaataaaaattagctgagcgtggtgttgtgaagctgtagtcctagctacttgggagactgaggcaggaggattacttgagcccaggagtttgagtttacagtgagctgtgatcacacccctgcactccagcctgggcaacagagtgagaccttgtctcgcggggtgggggagtcatgtctatacttgagaagtttttttccctcgcatagtttgtacctataaagtattcatcagttttgagcagtccttttgcgattgttttgagtcttgagtctggtgaccagtaagttgtatatatttgcctgtcaagtggacaaacatggcctttgtgcctttaagtaatggctaaaagtaccaaacagaacagggcctggcatagatgctgctcctcctgttcctaggccgtaatcacccctgattcatcagaccccaaacaagtcagctcctctccctcctgtgccccaccacccaatctcctgcaggaagatgtctagagacccctgtcagcgctaggcagagatcaccatccatgtccacctttcctctgatgcaggttcccactagcccctctggcttgtgccatgccagccatgaactcaccctcatgccccacccgagccctggcacaggctattccctctgcctggaatgctcttcgtcagtatccccatggctccctccctccccttcccttgtatcctgactctcccatagcagctctctccctgtaacacatgttcacaggttcatctttgtcacccatctccggcagctcctgcaggcttgatggctgctaaaggcaggcaagtcagtggctcagattcttgcaaacttagtgattagtgatttctcaactccctcctcatgcctcctctgtctctataggcacatattatttcttatctcttctcagaaccaagccgcctgaatttctgaataacattgtttaagtgttctgtgtatgcaaaagaaaaacgagaataaaaggattattaaggaagaattaatataataatagccacatattatgctctttttatactctgctaagtgctttacatgaattatttcctttaattagacaatcttaagaacatcgacatttttatgaagcccattttacaggtgggtgagtggaggctgggagtggcttaaatcactttccccaaaccagggagttagtgggagccagaggcaggacctgagctcgcgggtctgagctccaaagctcattctctgaactgtgcacagcactgggctgcagccagagatgcaggacgctgcgggaccctctggaggtggtcctgcctgtgcttccctcttcccacaggaagctccctataggcatctgtgttgggcgtggactctcagtgtacctgcatgtctccctgttggccagacaccaacactgaatggaaaacatgtttctgggcattttaatgtacgtacttgccttcagtcaatctcctccgcccccttccatcctgaccgcctccctaatagttagcagtgggactggagcttgaatggcaactgatttctgtctgagaggacaaatcaggcatctttgtcctctgccactgtctgttccccatccttaggatgcacgatgccagagccctccactgtggtctgtgaccactttgacccacactagcaggtctccatatgttccttccagctgagagacatcacatccaaagacagtttagagctctgaggtttctttccccagaggtccctgctttgtgcaaactgtctccagccaagcgtgcacaagactctgttcctgatttgcctgggcggctgagccatgggcagctgagcctgcagccgctggactcactgcattcccactctgactttggcatgaaagacacacaagtgtgcttgtgagaaatagatcttaacagtaccttttaacacctatttcaggtgctcaaaatgactgcctgttttacatttatattctggcagtgcaaacttcaattggacaggaaatcttacaacctctcttccaggtgaaaaagcgaggcagggatgtttatacagttccatccatgtcatcccacttggaagatactagtaaaacacaccaacagtaatacaaaaaccatggtgtttgcaatagtgataatgttactagtgaaggaaaaatagaaactttctgtaatttggagattctaatttttataggtgggctaaaaaaaaaatctggagagaagggtgttaagtgagtaaggagtgtgtctctaactaaatatagtgtaaaaagagaagaaaatacaaagtcaggcacagtggatagaggtggatagtctaatctctaatagtataatgggcaaaattgtctcaaacaaaattagtctgcctcttgtttactcagggatgtgtgactgttttctatgcacaaaatccccatgaaataattaagttgcaagaatctgaactttatattttggaaacctatctgaggtaggtaggaagttaatttatatttagaaatttgcttgcatatgtctagtagctccaggacaaatattcccaaatcccagactatttttttttctttttaaattcaacagtgaccagttggtctcttgtaagaattacagccttaagttagcaaagtctaagagggctggttttaatcctgaacctcagagggtccctgcttctcaaatactaagtaggtcacgtgcacagcaggtactacattgaagggaaattgtatgataaataggaaatcagcgatttttacttggagacttggcaaggcaaatgtttttgtaataaaaatagatcgtgaaatagaatcctgaaagctgcctgtttaaatgtaaagcaaatggctttagtgatgctttaagtgtggcagtcacttctggctgccgcagaaactatagaaagtgcattctctcttggtgctgtgggttcttagggtgaatgccttgtgtgacgctgagtatgtggaaggaccattcattcttggtaactatacactaggcagagggtggcgttagcgaagctactgcaggttgggtgtgtttaagatttggatttatttttcttttaatttttatttttagttccagggtacatgtgcaggatgtgcaggtttgttacatggttaaacgtgtgccatggtggtttgctgtacctatcaacccatcacctaggtattaagtccagcatgtggttatttttcgtaatgctctccctgctccctgccgccccccaacaggctccagtgtttgttgttccctttcctatgtccatgtgttctcatgattcagctcccatctatgagcaaaaacatgtggtgtttggttttctgttcctgcgttagtttgctgaggataatggctttcagcttcatccatgtccctgcaaaggacatggtctcattcatttttatggctgcatagtagtccatggtgtatatgtaccacattttctttatctagtctatcattgatgggcatttgggttgattccatgtctttgctattgtgaatagtgctgcagtgaacatatgcatgcatgtatctttgtaacagagtggtttatattcctttggttatgtacccaggaatgggattgctgggtcaaatggtatttctagttctagatctttgaggaattgccacaccatcttctacaatgtttgaactaatttacattctcaccaacagtgtaaaagcattcttacttctccgcaacctcaccagcatctgttgtttcttgactttttaataatcaccgttctgactggtgtgagacagtatctccttgtggttttgatttgcatttctctaatgatcagtgatgttgagctttttttcatgtttgttggctgtatgaatatcttcttttgagaagtgtctgttcatgagagagacatatttgctcctctgagtaaagggtaaggatgcttacgtctgtgtgacagccttctctctttttcagaacctcactgtggatcgccatcgttggcctgtactgaaggtaaagcagatagaggcagtctcatctgtcagatgaagacctcatacacctgttgattaagaggctttcttcagatcatggtttagagcggtgttttacaaacttgatgtgcttggagtcttctggaaatcttgttaaaaggcagactctgttgcagtaggtccgggtgggttctgaagttctaacaagctccccagtgaggctgatgtttcaggtccactgtgaggaggcagggcttagaataaacaaccgtgggaaatccagtccagatctttgatgcatcctaggttaggcctgtctgtcaggctgccctgggtctctagtgatggactccaggagtctctcaagtctcaaataagtctgagtcatcagggatattttttgagaagagttgtgctgtctgaagaagcaaagagtgagtgtgatggggaaaatgcagtgattaaaaacatggtaaggtttaaagaaagatttgaccatatgccaggtgaacccaaatgtatggtgctttgcgtctttcctgccctttggttttccagggaggcaaggccttatctcttatggagcacaggagacacagtgtgggcgtttgttttctcagccgtgggctctaacctaattgtcaagcctacaaaaaaaaaatgctgaaaatcaacttctgactagatatctggtagtacataatctccataattttctctctgggtgtattatgcaaaagataatcctttgttattaagaaacaatttttaaggcaactcccaactttgaaacggggaaaaatcattttatttacctctatgtgctagggaacaatattaaatttagttttatacttttcctttaagcatttcagattatattgtgcatttcaccaacaatagaagctttcagactttatatgtcttgtaaaaaaaagcctaatatagataagaataatttattgatttgaaacccattgtataagaaatagtccagtgaaacttaagttcaaagttttttttgtcttgtggatgtagctatgtcaatatgcctagtttatagtaacattaagtctagtggattagatattagatatcaattgagatgtaagcagtaataaacagtaatgcctaaactgaagtatataatctgaatctttatgatgaccaatttatattattgtgaaaaacttaggaactgatttgaaacatgatttacatgttttacatgaaacatgatttacatgtgtcatatatagttttcaataatttacgtaccagcaggaaattttagtggataagtggaataaactgcaggtgaaactttgctggaaaatacaagcatagtgacatctgtgcaccaaaagcacctggggagattttttaaaacatgggccagacatgccttcctggctgtctccctcactgtcagtgagtgtggggatggggtctgggcctgaattctttctttttagactcctcaggattctgattgctgccacgttgagagggttgacctcaattcggacctcagagggtgacttgagaaactgtcaccacttggtggcagtgttgctccccgcatcttgattgcccttgtttctttccaatcccggaaaagtgtgcttgtttttttttttttccctgcgtgtttttgtttttgatcttgctataatatttatattccttgctcatttgcaacttatttgaatggagagctactttctgaaatctagatgtttttctttttctacagggttttagggcatgggcaaaacacggaagaaaaaagttgtcttcagttggcagagacgtggatttttaagattgttcttaatttactttctgtataactttgcttttctgtggtgaacaaagaccaggttcaagataaaatattgcaagccaagaatctgattgttcatggatttctatggttaaagatacttgatcacctccccatccgccccctaccccacccaccctgcgccgcccccacaccccattgtgcttcttggcttgtcatttcaaaagtcaaggaagtcacagtgaatggcaagattttacctcgacttgctatttttgtgcctgttaacaattgtgagttaacactgactgagcttttcctagtgaacctccggcgtttaaacagccagtccataacactgtgtgagggctggagctaaggttattggtgacacaagatagcacctgagccagtgctgcttggtaggagggctgaggggaagagggctgagggcttggatgctgagatgctagagtcacatcgcctggatttgaatccctgccctcctgttctgataccagctgacccatgacgatgctacagcacctgacagcagattcctccttagggctggtctaactctagagtgtgtgcctgtgtgcctgcaggagaatgtccaaagtgagtgatcttgatctgttaacctttgaattttaacctataccagggagccattgaagagtttaaagcaagtgaatgacgagtagtttgaaaatatttccaggtggatagaatttgtggacatacatgaacatgagcagcctcaaaatcagggctgggactagagtgaggccagcacgtgtccagggtgcaaaatgtaaggaggcattcactttcagggcctggcaggtgtggaccctgaacttccaggaccttgagagtgagtgtctcctaaggattacaccctgggggcctatttgcctcatcctggtccctggtcctctgtgtaccctattgcctgcttcagtaaacaggcagccctgcaagggaaggaagggttggatcagctctgaggagggagtttttttagaaggatagatttgttttgtttaaaaaacagctttattgagatataattcacatcctatacagtttgttcatttaaaatgtacaattcaatgttgtgaggttattttttggtatatccacagagttgtgtgaccatgaccacagtctaattttttttattttttattttttgagacggagtattgctctgtcgcccaggctggagtgcagtggtgcgatctcggctcattgcaacctctgcctcctgggttcaagtgattctcatgcctcagcgacctgagtagctgggattacaggcatgccccaccaagcctggctaatttttatatgtttactagagacggggtttcaccatgttggccagactggtctacaactcatggcctcaagtgatccttctgcctcagcctcccaaagtgttgggattacaggcgtgagcccgacccaccgcagtctaattttgaaacattttttgtccccctagaaaaaaacctgtagttgtcacttgccaatctactgccgtccacctctaaccatagacagcccctaatctactttctgtctctatagatttgcctattctgaacacttcatctaagtgcaatcatataatatgtggtcttttgtgtctggcttctttgatttaacatgttttcaaaattcattatgtcataatacataccagtaatccattcttttttaatgacttattaatattccgttgtatagagacatcacatatggtttatcctttaccagtcgagaggcatttggattgtttgcacttttggctgttacggataataccgctgtgaacattgatgtatgtgtttttgtgtgttgaatgtgagctggtgtggaaactcctcctccaggggggccttacctgtgattctacccacggggatggttaagccagcagggatgggaagggtttggtcctgctggccctaggctttcctgcaggctgccatgtgcctttcttctgcctaggctgaaacggaggctgccctggtttctggcactgccctcatgagtgtgtgggaaggctgggggaagccaagtctccatggtgcctccatcagggaccctgcagctgggaggcagccagagggccacaggttggtagcattcacacagagctacatttctttttttttttttttttgagacaatcttgctctgtcgcccaggctggagtgcagtggtgcgatctccgctcactgccacctccacctcccaggttcaaggaattctcctgcctcagcctcccaagtagctgggactacaggcgtgcgctgccatgcccggctaattttttgtgtttttagtagagacggggtttcaccacgttgaccaggatggtcttcatctcccgacctcgcgattcacctgcctcggcctcccaaaaagtgctgggattacaggcgtgagccaccatgcccagcctacatttcttttttttttttctttgagatggagtcttgctctgtcacccaggctggagtgcaggggcaccatctctgctcactgcaacctccgcctcctgagttcaagtgattctcctgcctcagcctccggagtagctgggattacaggcaactgccaccacacctggctaatttttttatttttattttttaatagagacggagtttttccatgttgaccaggctggtctcgaactcctgacctcaagtggcctcaagaggccaatccgccttggcctccccaagtgctgggattataggtgtgagccactgcacccacccagcccgtagctacatttctgtcagctgtttgcaaactgtgccccagaatcccctggaggacttgtagaaccaccagttactgggttacgcccccaaatgtctgatgctggagatgaattatcttgggtggagccctcaagccgcagcagctgataagcatggggacctcctattctgataaaaattccaaaaaagtcctgagtgattaataaacagcacattgaaaattagaaatgagttctatggcaggggatgaaacaggcaacaaagcctattttctttgcaatgaagcgcatcagatattaataatagccattgtaattatctttatcatgtattaagcattttgtgtttttcacttttacacaattagatgatccccataggtattaccgcctttttttttttttttttttgagacagagtcttgctctatcccccaggctggagtgcagtggcacgatcttggctcactgcaacctctacctcccaggttcaagctattctcatgcttcaccctccttagtagctgggattacaggcgcctgccaccagacccagctaattttttgtatcttttttagtagagacagggtttcgccatgttgggcaggctggtctcgaactcctgacctcaggtgatccgcccacctcggcctcccaaagtgctgggattataggcgtgggtcaccacaactggacttactgcccatcttttaagagatgaggacagaaagattgagtgacacagttatgtctcctgcagctcttggttcacatagccaggattcgtatcaatctatttagctctaaatctagtctcttaatcacagtaatgaaccgttgacagttttacgagtaaattatcaagagttttgataggtttgctcacttaaattagtgcttgtacagtaatgggctgtgttagtgtgaaggaatgtatcttatgttggaagtactctagaattaaatgttaactcttgctaataaagcatacatttggggcattattagcaactttttttttttttttttagcaaaattagaggcttcctagttgagtggtttatgttatttatatttatttatttgtttgtttgtgacagggtcttgctctgtcacccaggctggagtacagtaagtagcacaatcatagctcactgcagcctcgacctcttgggctcaagcagtcccctgcctcagcctcctaagtgcctgggaccacaggtgcgcatcaccacgccctgctaaatgtttacagtttttgtagagacagggtctcaccatgttgcccaggctggtcttgaactcttgaattaaagcaatcctcttgcttcagactcccaacatgctgggattacaggttgtgccactgcgccaggcctccatgtatttgaatgaaagagcagacatctcctggaggtggcaaagctatgcatgccccccctggaggggagctgggggctctggggttacagtgatggcacattcagggagctctccgctttgtgagatcctgagataaagccaaaggatgcattaaactgcttctaaatgaactttttccaagtgaatttgttatatcacttctatataaatgaaaatatttgcagcatgagtactaacaagattttttttttcttttaccccgatggagtctcgctctgtcgccgggctggagtgcagtggtgcaatcttggctcactgcaacctccgcctcctgggttcaagcgattctcctgcctcagcctcccgagtagctgggattacaggtgcgcaccaccacgcccagctaatttttgtatttttagtaaagatggggtttcaccatgttaaccaggatggtctctatctcttgactttgtgatctgcccgcctcggcctcccaaagtgctgggattacaggtgtgagccacgctcccggccaagattttaaacattatttaccaaagtaggaacgtggtaattatggtcttatataattctgaaaatgatttctagtaccaaactatgaattttatacttgaaagaatgatgggtttttcacagaaagttgaagttattatggtttgtttcctgttcaggtgtttttgctggagaatgttcgatgaacagcagttctggtgataagttatggatgtacacagctggtgtggtttttaggattttattttgcagcagcatcttcctcaaacagttgccaggggacggctttccttcttcttactggtaccagcctttctcttgcagacaaggcagtatgggagggttgggagacaaaacagaagctgttggtttcttcagcctggcaaggattcagattgcaggttgtagattggaggccgtcagtggggatacctttccggacaaagtggtgtttctgcctggcactgcttgccagagaagtttcagttcttcattctccgtcagagaaacccatatggaccacattctgatagttttcttctgtttccctaacaccgaaggctcagcccctggtgcaggtcccagtgtacagcaggctgcatacagttagaccagatgttcttgtagtacgaaaagtcaccgagtttccattcacttgtgggtggcaggtatggccctccttacctcccatggcccaggtttctctgtcctgccgttttcacattttccaggctttcacctccaggtaccaaaattcacatcatttagagattgtgtctgcctgccaatacgcggatgtaccagtgagggattgttctcgcctgacgagaggtctggatgatgagagagcagagctggccctggggctcagtggtgacaccctcgagcttggctgcttctgttcttctgcttcctctgcttggattccttcgcctttggcttcccctccagttccaagcagaacaaaacaggagatatcaaggaggaaagggtgacccctctatatctggagagcaaaactgtcgcggaaatccctagtgtacttccatttgtgtctcattatctgaaaccgagttacctggctggtcacgtgcagccaccagaggcaggaaggtagtgattctgcctgtgtggaatgttctagcattccctggtagcttttgtttcttcaggcagccatgactttgcatagatcatttccttttgcccaggacactcctgctcgttttctcccctcctcaccaaacccacagtgcattaacagcgacagacttctcctcatcctctcaggccacttggatgtcaccatttcttctctttacccctcaggcgtagtcagcctctctgtgcctgatgttttatggctttgtgtatgccccgatggagagcgtcttactgtgtcttcgggttatttatctcaacctcgcatctgtgctatcctgtacagtaaccaacagccacatatcactatttaaaattaaatacaaactaattatacttaaatgtaataaaaatgtagcccctcacattagcctcatttcaagagccacatgtggctaccgtattgtaagcagagctcaagaacattcagcaatattgtgagagtggctaccatattgagagcagagctctagaacattcccttatcccagaaagttctcttggacatgctgctcaaggtggtgaactctgagatctccagtccccccagctccgtcactcagaaccacaaatgtggcaccatcagccttcagggtggtgcttgtgttgtactgtctcctgactaaagaagtaaacttcaggcagtcaagattttctacaacccacactgctcctaaaactagtgttactggatatgtaaaagctattgagcccagtgctttcaaggaatcctaaaagcaagtggggactgtcatgtatccaggttccttgttttgcagaagaagaaatagaggctttaggggaaaggggtccactcaaggtcatacaggcaaggtcatacagtcagtggtagaatggactggaatcttgattgttcatctcactcccctttccattaagccataactgattgagtatcaccaacctgtttgttttccctgattatgttcccttctcgcctgtttaatcaggtttcagctccttgtgagaggaagttgttttcagcttcttagccccctacctgtaggcggtgctctgggaacgctcaggaagcagatgcatgtgagcctgtctcagccaatgattgcttagttgcaagaaacaaaaaaatgactcaaactagcttaatcaaaaggaggcttttaaacagcaagataagggtaaaggctgggaactaggaagttgtcaggaaccaaggctgtctctctggatctctctttgaggccatgtaatttttttttcctctcggtctctttattctgcacaccagctcacccagcttgcttgttactatatgcagtcatgccaacccccagatctgtatgacctgttagcctcaggggcacccacgtagctggctgccaatctgtgttttcttccaggtttcgagagggagaaatgattggcccagctcagggtcacttacccagggagaggtgggggaagtatggaggcaccgtggtatcagggaacccctgggccaagcttgtccaacccgcggcctgctttctttcattttttctgttttttgttttgttttgttttgtttttttacagctcatcagctattgttagtgtattttatgtgtggcccaagacaattcttcttctgctgtggctcagggaagccaaaagattggccacccctgtcctaggccattatctgggctgtgggaggtgtggagcagggtcagagctggagggggagggcatagcctccagccaccataagttggtgtgttcttggtaattatattgcttgtcaaccgaaggcagaatcaggacaatgaaagtaatgagaatccctagctttgtaacagttagtggttatctaaaagtaggtgaaattgtacatgagtgagtggcatgaatttcttattactaaagtgctcagatagctggctaactttctgtcaaagatccctctgctaggatcaacatttgattaatatatttatcctgtaataagaatttgggattcttaaagcaaaatagttgtcatgtggctgactacacaaccaaagatggtccaggtgtcgctggaagaggagagactgaagagctgttgccaggttcccacgtggaccttcggcatgacccggccatggggaggcctcacacgctcctgcatcgcccacatcttgccaagccatggaaaacacttgggattcatatctaaatcctagtttaagcttggtgaggacagtggcctggtgcagagtttgggtcatagatggtgcttggtttcttttgtataaaggggtatatgattttggaatatttaccaaatgtgggcattttttctataaaaattattgtatctactgagattatagtatgtaaaaaaaacatacacatggagaaagaatacaaagagagcattgatattctacagaagtggcaagaagatgtggtgataggtgatatttttgccttttgtttcaattttgtattgtagtgacttttttggtagaaaaaactaatttctaattaagggagaaacatttgaagtacatttagtctttctagaaaacctcatcttctcatagaagtttaagatggagacatacttccattgtgaatcatgatgctaaccagtattcagatttgttggaaatggactcagttttaaaattgcttctctcttgtgggctggaactgcaaatgattgtttggggatttttccccttttcttctatggagttattcaacttggcatgaccagtgatttgagctgagaacatggaacccttgatttgcagaaatcaagcccccaaaggtacagatacagtggtcattgtctgaagggtttcttttgttcttggccctcctgtccctgctcttactgtggcagctgcagctgcaggtgcctctgaagccttgccatccatggtcacttcctgcctgctccccacccacccctgggaaagagcccccaagtgtccaaaagcactgtgttgcctaatgcttgttgagagtctacatttctctagatctagcagaagtaaaatttcagtttgttatatttatagtttcaggaatagtttgggaatggatttaataaaaaatttaaaagcccatcatttttatatctctttttcgatatttgatggtttaaaagacatcaaagttatcttctcccattactcatcctatacaattaaaacctgttttttgaagttgtaataggtaagttagccttaggtcaccccatatttatgtaaactccagcccactgccacagctactttgattgtgatctgtcattgtgttacccactgtagggcagaaatggttcctgcctcatgccgttgctgctttactcttcctgaagtggtgtggttctgtctctgtagtccttggcacactgtaggttctcagatggcagggtgaaaagttcttctgtttgcttaaatctctcataataccctgagtctgtggagctcaataaattctacttggtattattgatagattatttggagccttttatgttagaaaagggattcttaatccaatgctccgttttacagatgagaagactgaggctcaaagaccatacccccaggagccatgatttgcactgtatttaggaatagtgtctagggtcagcacctggtgttggccgactgcagagcagcctggttaggagccctggggttgggcgggtctgggctgctggtgccacagcagtctccctcccctgggactttgggcctgctacccacccctgttccttcctttgtgagatagggctagcagtaactgtcttgtttcatcagaggcagtattgcataatgaatgagagctggggcctaaattaggcacaagtgcaagccctcagaaaactatgtacacctagagagagagagagacacacgtctgtatgacagagaggcagggtttgggaatgttctgatttcatgttttgaattggtgtgacctttgggaggatatccttggaatcgcagagcttcgtttacatcatgactttcctgcccacccacattttctgagaggccagagttttaaatgtggaccccgtgagcttttctctgttgcctcattttggcctgtggccttttgttttcttggtatgtcatgaggcaaaataaaatgaaactcagtgctggttaataactcccatcataatgtatatttctgtgaatggctttttagccatttgagaggaaaaagggtcatgtaaatttcagaaaggcctgattggctggagagtcagtgtagtgtcacagttaagagtatagatttaaaaaaaattttttattgtggtaaaaaacataaacataatactaccatctaaaccatatttaagtataaagttcagtagtgttaagtatattcacattgttgtgcaatggatctgcagaatttttcatcttgttaaactgaaactctatgcccaataaacaactcctattccccctctcccagcccctggcaaccaccattctactttctgtttctctgagtttgactactgtagataactcatttaagtagagtcatatggtatttgtcttcttatttctggtttatttcgcttagcataatgtcctcaaggttcattcacgttgtagcatatgacaggatttctctcttttttttccgccttttttttgagttatattctgttgtatgtatatttaacattttcttcattcatctgttgacattcatctgcttccaccttccaccttttggctattgtgaagactgcagctatgaacatgggtgtgcaaatgtctcttcaagatcctgctttcagttctttcggatatgtacccagaagtgggtttgctggatcgatcatagtgtagttctgtgagtaaccctcatactgttttctgcagctgctgtaccattttacattcccaccaacagtgcccaagggctccagttcctctacaccctcacccacacttgtaatcttctggattgcagattttctggatcaatcttctggattacacttgattttctgtgttgggcctggatgtttagaacagtatccctcctttggagtggtaaatatgtaagtttttattataaaataatggccatcctagtgagcgtgaggtaatatctcattgtggttttgatttccttcatagttaatgtggttgggcatcatttcatgtcctggtcggccatttatgtttcatatttggggaaatgtcttttcaagtctcaagtcctttgcccattttttaattgagttatttgattttctactgttgagtatggattattaaatcagactggcctgaacttaaatcatggcccttccatttttgaccaaaagcagctgtgtgtcccatttgtgccttggtttcttcggtgtaatgccggcataatgatagccccaccttgtagttaagagtgttggggcagtcagtgaggaagcactcactccacaggagcttgttacgtaaggagaaggcagccggtccattcctaataggggtctgaaggaaggaagaagggctgaaggaagtaaaaagagcctcctccatgaatggcagccattcttgaaatccaccttggctgccttcatttttaatgtcagtggacttttaagacaaccaaaaggatgttcttggatgaccagagactgtggcagagggaggatggtcacattgccaaggatctctctcaacctcttggatagtgtgctgctggtagtttgcacaattgcttcagctttttggcaaagtacatgtaaaatcctgaagtcactgccagaggaaacctggttcctgagatagcagcttgatgctcctgccccatcccaggtgcacacctcactgggcagctctggctctgaattgagggacagcaaaaacctctaaccaaccatactgaaaagcaggcattgggggctttaggggaaggttcttttcaaaactcatgatggggagagaccaaagactgggaatcattgtaaagaagttagtcatagatgcttcactctttacaatcatcccaacacaaggttaaacaacatgcagttttcacgatgtcccagaaagcgacgagtgcagtgaggtgaaacgtggccatctgagcacacaatgaccaggcttggaaggatcgatttcccctgtgctggccctcagaatttaaggcacaacttttaagctgagtgtgcagcactcgattttctatgttgggcctggatgtttagaaaagtatctctccttcagagtggtaaatatgcaaattttttactgaattacttcatttaatcaaagcagccgacttctcctgcctcccctgtttctgtcttggggttgaatatttggtcccatgtaacaactcttgattcttaatgatgccacatggaagctgtgtgtgctgggatttgccatattcagttatggtcagtagagactttcttagtctctctctctttttttttttttttgagacaaattcttgctctgtcacccaggctggagtgcagtggcccaatcttggctcgctgcaacctctgcctccgggttcaaatgattctcctgcctcagcctcccgagtagctgggattgcaggcacgcgccaccatacttggctaatttttgtatttttagtagagacagggttttgccatgttgtccagactagtcttgaactcctgacctcgtcatccgcctgccttggtctcccaaagtgctgggattacaggcgtgagccaccgcgcctggccacagtcagtagagacttttgaaaggaaatattacctctttaatgatgtttttagtccaagtaaattgtggtaatgtttaagaaatttgcttaccacaaaaacagttttcaaggagcatttgaacttgtccactttaagtcataaaatggattaaagtgtttgaaatctattgggattgtaaatttatgtcagtgtactgactttcaagagatcttgatgatcatgtcgtctgttttcattttctactacatgagaacattgaagcctgaaacttaacacaaacccgagttccccacttgcctaagagtcatggatacctaaaaagtatgctacttcccaagttgatttctttcaggatatgggcccttcaaaggaaagcagtgaggctggggttttccaggtggaaaggtcacatttccacatataactcagcgaacattgtgttgggttgggagaagaattggttcactattttaaactttttgtttcatcttgaggacttccccatcccctctcctccgcaaagcacaaaagtatttcctaatttttaagtcatgggcttcctttaatggattctgaactcagatcacgtccagataagcattgtgtaatgggatgggtggggttagatattttagtcacagatgcatgagaggagggagggtggaggacagcaaagtttataactggagcctatagtagtttatctcttgtcatcggccaggtcacagagtctcacttcaggacagctgtgcaagcagaacccccatcacggttttcttgatgcctttgacagtcacctgtacatgcctctgggacctttcctcctcctttctctttttgttttttttcccttggtcacatgtttcattctactaaatgtctaaccagctcttctctgtaaattacagagctgtgatggcaccttgcttgttgattatttctggttgaatagtttccaatgggacttctctggagataagtcctgtattagtccgttctcacactgctaataaaaacatacctgagactgggtaatttataaaggaaagaggttgactcacagttcagcatggctggggagacctcaggaaacttacaatcgtggtggaaggggaagcaaacatgtccttcacatggcagcaggagagagaagtgccgagcaaaaggggggaaagccctttataaaaccatcagatctcatgagaactaactcactatcatgagaacaggatgggggaaactgcccccatgattaaattatctctgcctggtccctcccatgacatggggattatgagaactacaattcaagatgagaattggtggtgacatagccaaaccacattaaatcccaagtgcgcatgtctggccctgatccctttatgtgagactggggtcatgatcctcccgcacccgtcttctgagccctattcctacttgggcatgcttaggcacttcagcatctgcatcccattgatgtcttaagggtggttccagaccttggaggtacacacgacacactgctgatgaaaacctagaatatagaatggaagttacatttattcatagagtgaaaatccaaaaatagaccagagagaagatatgaaaatatcaagaatgcttatcttagggaggtaggattataggtaactttttttttccttagataaatatatagatagatatattagtgtttacagtttctctgccaccaaccaaaatatttttttcaggaggaaaaaaaaccccagccagccaacatacctaaaaaccatctcctgggcccgagagggaaaaattgggctccttttcttgaaattgccatttgtgccactgttgtattattttaccagtaactccagattccaggctcctgtatctgagttctctctccttccacagtggagctcataccttcctgtttcctggctgccactcagatttaggctccgtttttcagacctcagtggctgtaatagctgttccttctacctcttaggatggttctttctgtaatagcctttgtcatcacatcatcagaggatgatagctcttaatgaggatctaaaatttgcaggtaagatatccctgcctctgacatgagatagatgtattgcatgctatttaacatacaactatactgagtgtgcagttgtatgtaaaagcattgttctaggtattgggttgaaagtggatcaaatgctagacaaaggagcgtacaagtcttgtaaggaagacagctgccaagagagaagaaaggatggggaaatgctgcgtctactaagttcaaggttctgaattggaaagctgcagctattgaggagaagagtcttttaaaattcctaaagggtttttgttatcttttattgatgcaaatgctattttgtggcataaaccttaataattttggggttgaaactcttatcaggataaaatgatccttttctatcccaagcttaataaatattgtttaagtacaaattaaatatatgaaatctgcccatctatattataaatgtcatatggcagaaattataccttgacttttggttctttcacaaaaccttaattttttttttttttttttgccttcaatgaattttgtctgattttacattaaaagcctgtaatttctcaagtcttgagtctggggagccgtcgtcatccttttttcccctctcccttgtcttctggatgttcaagcgattttaattagatgttgggcttttatgtcaagtgctggcattgcactccatgataatccagggactcggaagcacatgttatgcgtcaccctgggttggtgcagtggaactggggtgggttggaagtagtattctaaatctgcttcctgcgatggggtaggtcaggttgtcctgtgttgacaaggaagaagtctgggtgaggaagcgggatgaaagcagaccagacgctagagtccactttcaagtccgatcccaggacctggcttaaagttaaagaacagcaaagatgaaaggtgccgcacagcagcacaggtcggtggccacgttaatgacatagaaagcaagtgctgtgaattcaaaagaaaggacagctctgagccagagtacttggtgactttgctcaaacaaatccctttctggcacccccaggccttccctcccgcttcaaaaaaattctgaattgtgccaatccattgaggctcagctcaaggccatcccatgcctttccatcgtaataaagccttgtttcctgggctttaaacatattccttttttcttaggtacagattgaacttttttaaaagggaagttgtcagaggctctgtaaaacgttaaatcaaacctgctttgttttagggatggggtagcttggaatcagatttgctcctgctatggactgaacatttgtgtccccccaaaattcctatgttgaagccctaatgcacagtgttatggtgtttgaagggaggcccttgggaggtgattaagtttagatgagattgtgtgagtgaagccctcatgaatgggattactgtcatcccaaaaagaggtagagaccccagagcttcctctctcttcaccctgtgaggatacagcaagaaggaagctctctgcaagtcaggaagagagagggctctcactagaatacacttgtactgccaccctgatcttggacttcccctccagaactgtgagaaacaaatgtgtgttgtttaagccacccagtccctatgattttattagagcagcccgagctccattctccactccctggcttcctgcatggactttgcaaccagagcttcacggggtatagtttaatagctgtttctctgtaacatagccacttttctctttccaggtctagttttgaccctcataacactttgttaggggagatttgagggtgaggaagttggcttgcttttcttttcaccatgtctcagtagaaacagaagcagaaaggccctgagatactgagcccacctttctcagcagggtgtgacagcccggagtaccctgggctgaggaggccagggctggaggggaggctcccacggtggaggggttgaaagctgggttgtaatgagctgcttttctgtagatgcctaaatgatgtgggttgagaaatcgtgatcttagcttttagtagtatatttttctgtttatgttaggtgagtcatcagtctgtctctgactatgttcagatctggaagttttctggaaggaaatttgttattgctgtaatagtgtaggttgttgatctggattagcagggagcggccccttaatacattcttaagaaaatggtatttagttcagtctttggctttgaactttgcctttgacaaagatgaaagtgcgacttgactggtgtttgaaaaacatggtgatatggccaggtgtggtggctcatgcctgtatcccagcacgttgggaggccgaggcgggcagatcacctgagatcaggagttcgacacctgacttggtcaacgtggtgaaacctcatctctacttaaaatacaaaaaaattagccaggtgtggtggtgtgcacccataattgcagctacttgggaggctgaggcaagggaatcacttgaaccctggaaggcggaggttgcaatgagccaagattgtgccattgcagtccagcctgggcaacaagagcgagactccatctcaaaaaaaaaaagcaagttatattacattttaaaactctatttaatggtcaggtcatccatccataatgggtagagtcattgcttaattaatttaaaacaatgtatttaaaaggtacctttgttccctagtgtcacataacgtgaaatatccaattaaggtaactgtaatgtaaagtaagtggctaaaaaagtgctgaacgccaaaggccagagattcaaccttttgtgtgcattagaatttcccaattgttcaaatccaggttgctggatctaccccagagtttttgatccagtaggtttggggtgggaccaagaatttgcatttctaacaagctcccaggtggtgttgaggctgaagctcgtgtggggaccacattttgagaacttctcccgtagactgaactcatggtctaggttctgtcagctgtgacccctgtgctgctggagggagtggtcagatgtcctgacctctgtgcccacagtgaggtccaagctgagtaggtttgaccagcagctgtaatcacagagtgaacaatgtaaacgaccaatgttgggtggtctgacatcttttaaaaaaaatccacgtggatgagatcacagggttaagtgtgggcagcagtcagggtaactccatgtggttactgcccatgcactctctgctgtttttcacctcttcttcagagtgtggtcaggatggtggccttgcccagcacaggaggcccttttccttctgaccacctgacctgacccacctcttagcatctgcaggcactccctgtcccttcgctgggccccgtggggaactacttgcagtcatcaaattcatcatgctgctttcttttaattcccacacttgccaaggtgggactgccccgcatctccttcccagtcgtgtgtcagaactcagcactggacctttcccctttccccactcccacccctcctcaccccgacgaacgtctcacttgggatcatctcttctgaggttggacctgcacagccgccctctgcactctcgccaccttatgggctgcccttgaccccttggcacacagacctggaagttggcctgctcagctgtctccttaggggtggagcttggttttctttcatcactgttctgcgatgaattgaatgcatgattggtcacaggaaggtaggggagggataaacaccttatgatatgtttcttataaggttttatatgtagaaagttatatgaaagtgtcagatatctatatatgaagtatatgtgaagttttatgatagttttgcataatttaagaataaactctttaaaggagctgagtcccaatcccttgggtcgagagttgcgtggctcccggggcctgcttgtttccttccactctgcgtgttcgttgctggcccctcataggctgtcccagacctctttgacttctctcctttctgcccagtcttccctgagacgctccaggctccctggcctcctgcttctcggagcttctcttgtgtttgttttctgtgctcagggcgccatggtgctataggccacagaggaggcgtctggggtccctcggggcaggtgcagcaggaggaagccgtctccgagggcatgaccttggaactgagcattgacagaggagagtcagccagacaaagaaaggccaaaaccccacccctctcccaccctatttctacgtgaccatgggccctggacacagcaagacggtgaccccgggcctcctattgttgcgaggagcccctgggaaaatgttggcattttcttcatagaacaggtttctcttctccagtattcttcagtaaatcaactttcttttttatccccaaccccagtctgattgcgaagaagtctaagcaacagaaagattttgccaaatagattatcttttttagaacaaaatagatcatgatattaataggaattcagcacttactcttgtctaagtactgtttttaagtgctctcaaggatttttcatttaatccccacaacaaagctgtggggggtggatgctattattatcggtgatttatgaatgaggaaactgacacagaggggtggtcgaggagcttgcccatttcctggtagttagtaccagggctggcatcatcagttgcctgctccttttcctctttgcttttgtgtccattaccccaaggcattaggatgagccagccaagttctagtcctggattcaccacctaattagctctgtgtcccatgtcttgccgtggagggataaaaccaattcctagcttatccgttggtggtgaagatgaaatcagtggggtacttgtaaagcacactgcccagcacatagtaagtgcccagaaaatgtgacgtcggacctctttaagcttcagtttccacatctgggaagagagggggagttgagctaagtcattttccagtgtccctttcagctccatgttcctgtgagcactgacagtttccccacaatactgaagaaagaaggaaaataagggcggggtggcgaaggtcgccactgtgacgtggctgctggtgggaagtccctggggaggcaaggcccagcttcccagacacagccctcaggtgctcatcctggtggcactgaccaggggccatggtgggcttttccaccccaccatgtctcataaaattacaagaaccacagttgaaaatcagtgttacagaaatggtaataggatagggcaaactgttacaaagatcagcacttaagattctggctgaggcggaatatttgtttctctttagttttgttgtctttaatcaagaactgagagccctgactttcagctcctcaaaaaatacagcttccttccccttgcagatgcaaaaacaaacgccacttctttccaagcataattttctcccatgcgttatctcctgtctacagctttttcttgatccttctccagctcctgtagacctcccatttagagccaccagccgcccatcactggggctgcgcagagctcttggtgctctgtgccctgggctcgcccacccaggcctgttctctgtgcctcttcctggttctcttccctggacttcccactgccgtgtggtcttcagtgctcctctgagctgttgtcatgacctctaaccagactgagtcaggacttttttcttcctcatctctaagtcatccttacacagccttggaagtttaccctaaatggctattttgggagggagtggggataaagatctgcaggcctcttgctcctggtccttgtttctgcttatcttggcttctgtttttaagtgtgtgtgcacctctttcctcatcacacccttcccctccgtatggctcccatctcaggcagagttaggtgctctgttctgtgtccatagctctttttcgagcccttcttctcactgtttggtagtggcctttcatgtgtgtctgatccactaggctgtgcactccctgcctgccaggatatggttaaagtgctaaagaatgtatatatgagatcacttttgcttaaaaaacccccaatcttctggaattcccaatttctaaccaattaatatgtggattgactagaccttaagcaaccaagagtcagccagccttgtcttctatattcaggcgcatactatctggtcgttagacaaaatgggtcattatcagtgatgagttaataattacctgcacatcttgtttatgctggttctttacctaaagtggctcccatcaattaaacctgtatggattttacctgttcttccagaaccaccccactttccacaaaaactgacaacaatgatggtaagaagaatggtagttgacattttattaaatgtttactgtgtgcaggcttgtttttttccacacatttacctacttaatgctcacaataatcctatgaactagtcagttttatgcagatttcgcagattaggaaactaaggtggcaagtgatcagataacctgtttgaggttgagtagctagatcatggtagagccaggttcaatcccagatacctggctccagggcccatgctcttgaccttataaacggctgaaattcatctttttttgctgaacttccagaacactttctttgtatttcccttattttggtagtcttgtacttctctgctaccctgattcatacttggatttctagcagcatgcctggcatgaggcaacaacttaacagtatttctttataccaaatgaatgttgtcttttttttttttttttttcttgagacagagtctcgctctgtcgcccaggctagagtgcagtggcactatcttggctcactgcaagctccgcctcccgggttcatgccattctcctgcctcagcctcccaagtagctgggactataggcgcctgccatggcgcccggctaattttttgtattagtagagacggggtttcaccgtgttagccaggatggtctcgatctcctgacctcatgatctgcccgcctcggcctcccaaagtgctgggattacaggtgtgagccaccatgcccggccatgaatgttgtctttaaaaaattctgttttcctctagctagactgtcatataatgcaactgtaggaaataatcaggttctctttggagtattttccataaaagatccacagaagtcatggcagggttgagagtggacttgggcaaatgaatctgttcattcattgaatattccatgcatatctgctgtttcccaggcatgggatatggcagggaacacagaaatctctgcctcctgggctctgctttctgttgtagtagaggtaaagctgctcatactttgtaaacaatatgacaacattaagtctacatggtcattttactttgtttttttctaagaaattttgagctgttcgtaacaacagacgctgcagatgttaatcccgttgttgttaacttttctccagagatttaatgttcaattttctcctttccagaatcgatttatgttgttcaaacagaggtttgagaataactggaatttttttaacttcttttttttttttcgcatggagttcagaattttcaagagggatgaagagagttataaaatgctctatggtgggtaacacacagaaaaagccagaaaattggagaataaggatctgtctactcgtttccttctagagctcctctttcttacagggcacttaacatgtgatttaatgtcgtgtctttaaaaggaggagaactgcagttcagaacttaatgtcagtgctttgtgaaagtgcaagaaagaagccctgtattctgcacttgagagagccagatactgggcagataggaggtggtgtgcacgttgctttttgtctttctcgatcatggcattgattctgttcataacaatgatgcaatgtcatcctcttccccacacatttgtgtgcagatagaaagaatgcaacagcacagagttgttggggaataatttggcatctaaaatatcgacataccagcatagatcatatttatgactctgttgggagtgtcacagcaatgatttaataggaggcagttgtctccaaggcctcctgaattatgactggttttaaaattcttagaacccattggaggctattgtttctgaaaggctacataatttaagtgctccacatccgtcattataggagatgtcagaatagtaaaatctaatcctggactaagttgttatcgcagccctttggtttggtggctttgccgactttataaatatgcctgtcagtgcctgtggtctctacagttgggcagtcggcggtgaatatcatttctcacattttacactgggggactggaacccagaaggcatatgttttcccaagaggcaccaacacagttggcccatgaggtagagcagcccctccttcggctcagcctccgctgcactgagccaagccaagcttcctacactggcctctgtgcagctgtctctcagcaagaatgcaagtcggggagagaagccggatccctgggattgttctagagagtagaaacctcagagtagccctccttagaccacctaacgcattgcatcgctgcatacatgtaagggactcaatgctggtaggattggcttaggaatgatgcaagtgaaaacagtgccccggtttatcattagaacaaggttcttagctgacagttgcctcagactttgattttgttctccttgacctgccactccactcgagtccacatctctcaagactgcacacgcctgaaggaggactgattacaaaccaaagccttgtgcccagtctggatctttttgcattgttgagaaagcagcttactttctttggactgattcagcaggccaaatttagaacaaagatttttaactatctccctttataaattactgagctattttgtagccaggctactcttaatatgaacaaaaaatattatacaaatttgttgttaatcgtaaactataaaaaaatcagtaattgttaccacgtgaaatgaatttggataaaagagatacgtttttgccccttcccagggtttaggagagacgaaatggtgagattttagctctgaatcagaggttcttattagaggtggttttgttcctcctgacccctaggggatatttagcaatgcctagaggcattgatggtgggcagatgctactatgccctctgctaaacattctacagtgtataaaactgttcctcctgacaaagaatcatccagccccaaaatgtcagtagtgctgaggttgagaaaccctcctttaaactcttgggtttatttgctgacctttacagtggatcagcttttatttagttcatgtagaggtgaaattaatactagtgctcaaatatgtctttgtattctggacttggcctggatcccccgaccaaatttgggacaagctcctgccatgtgttgaggacctgaattcaggcagctaacaacagtatttgaactgtgttttcagtggtgggagtgaaggagatgagccgacgtgctagcaagcgcatagggttgcatgaggaaatagagagtaaagctgcagcgtggagccctgctattcagagtgtgcttggagaaacagcagtggaggcattactggggagcttgatggaaatgctcccctcagacttgctgaatcaaaatctttaatttagcaagatccccagtgaggcttgtgcatgtagaagttagagaagcacggggtaaactcttcttttttttactttggaggaaaatacaccttttttcttattatggctctgacccttactagctgtgtgaccttggccaagttataaaacctcactgcaccttatttgttttagctggaaaatggagatcataatatcacctgtcctatgagattgttgtaagaatcaaacaagcttatttatgccaagaacccatatggtaaaagctcaacaaactgtcactagtgataataagaaaaagatcacaaaagtagaaaacattagggagacagcttaggtcttaaatctcacagttgtcgtccccaaacaatacttgtatttttgcagatccagtttctctgaatactaaaataaaaccggagtttcataaacttctatagacagtggtccttgtcagtagcccaagtggcagagagtacatggatctggggacaaacagcctctactgttaggaatgttccatcctcctggcctgagttacacctgctcattgtgattccgaatttgaaaggaacacagtaggaattttcaagaccctgggaagaggaaggctgtggtaaacaggaaggatgagattagaagaaggagtttaggtgaggtgagcccttgttttactagtagggtttaagaatatccaagtcagctggacatggtggctcacacctgtaattctagcactttgggaggccgaggtgggcagatcacctgaggtcaggagttcgagaccagtctggccaacatggtgaaaccccgtctcaactgaaaatacagaaattagcagggcatggtggcgcatgcctgtaattccaactactcactcgggagtctgaggcaggagaatcgcttgaacttgggaggtagaggttgcagtgagccaagattgcgccaccacactcccacctgggcaacagaatgagattccgtctcaaaaaaaaaaaaaaaaagaaaaaaaaaaaaaagaatatccaggtcaaccccacctaaccctcagcggggctcccttctgttgcctgggtgggtcctgggttctcttgacgcacacgagattgtgagagtgtatggaaacactgccctcgctatcaggacagcgcctgccatgccagccagaacacatcataggaattgcaaaactcttttgcaaaccagtgagagatatgcttccaatgtgaggtaaagcagaactttaatcacagctgcagtgttccacagaattccaagagccaagatggtaaaagaataaaaaaaaagaaaggaaagggctcaaattaaagacttcaagctgcagaataagattaaataaaaggattcaattgaactgcatcatattcagtaatgactaatcctaagtatacagggtttgggggtgaaaggatttgtaagtgttttgcaggaaaatattttttccatctttcattttaattagaatagatttgcattattttttcttagtttttatttttaaaatatttattgccacaaatttagaaaatacagggaaaacataaataacagtacatgtaaaccaatattttgtcccttcttttgttcaacagctatttctcaggcacctgctgggtgtcagcagctgtgctcagtgtggtgaccaaaacccttgtcaacaaggcagcaaggttctaacctggttagggcttacagttgagtagctgaaattttgatttcttttctgtgcccctagtaaagatatgatagcaaacaataagagctattttttttattgtgttcttactctgtgttgggccctgttctcagtggtttatagcctattaactcagtctctttaccaccactctgaggggaggctctgtcatacccacttgacagatcgggaagtggaagcatcaggaggttaagcaacttgttaaagatcacaaaatcaataatgacagagttttgattagaatcccagcagcctgtctccagaacctgccctattaagtgcagtgcaactgtactgcctttcataatatgtatcaaattgagatgatactttataatttcaattcttgcttttctattgaacagtacacagtaacatcctcctataatgcatataaacccccaaaagatgtagaattttaatttattcatttgtctgataggctcataatgaaataagactctataaagctgtgtaatttagatataggaaacatttggattatagtggtatgtagtgggaacaaatggtcttctgaatcaggaagacatgagttagagtatgccggtgtacctccttactcactgtatgaccttgggcaagtttctgaactttagtttcctttccaggctaatatctgccttctggacttgtcatcaggattaaatgagtctacctatataaaatgcccagcgcagtgcccagcacgtggtagaaggtctgctagtggttactgttactgctggctattaaatacattttaatcttccttcagaatacctggccagatagcacagtggttaagaatgcacatgaaagccagactgttgggttccagtcctggctcgactccttcctagctatgtgacattaggcaacttacataaactccttgttcctcagtttgcatttctttaaaactgcatagttatcatacccatgtcttagagttttgtgagtgtaaattattgtatataaagctctgagaacagtttggtacacagtaggcactgtatgaacattttctgtaattatcaataatataattattaaataacattttcagaaggagataaaaatattacaccttaaaaagcaggtatctttaaattcttcctcagctactgaagttttgcttactatttgacatatcatttgtttcacgtttgtggctcagacgtggcttatgccaatgcatattaacacaggaattttaaatttggtgatattattatattttatctgaatgaacagaatttgctgatttgacactgtgtttgaatgtgcattttttgttgaaaaatgacaattctggaatgccgtctccctttccagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaaggttggtttgccatcttgatattgaacaggcctggtcttatcttggctctgaagttaatcacatcagacataagcatgctgtcttaaaaatacagcagcacgatagtctaatgtatacatctatctatatctgtttactttttcagagtaatattaacactgtttactttctggtgatctaatgatagtttcaccaacaatattcattattcctctatggtcactgttagtacagtgtttagaacttctgagatccaagctttaaatctaagctctaacacgctgaaaggtgcttttcattttgttttgttttcccctctgtctctctctctctctactttatcctcagccatggtctgtgcctgtgtgttaggtatgaacttttcttgtgtaagtcattaacatacgtaacttcactctgtgtgctttttcagtgatttgcaagtaatctgaaaaaaaagaattagctgagttctacctgtactgatatcaatagtgtcaaaatatgacatgaactttgaaagtttagattttgttcatttcctgtttccatgctgacactggaaccaattaatgttatcttcaaagtagcttaagatgcaaagtttacatactctttggaaagagcatgagtcttagggtatctagagaactgcccggtgataaagtagtgaagattttgagcaggaagtctgcataatctctttcaaagggaagatgtagcagatggttcagtcaccctgccattgccccagaacaattttggaattacagtacatttcattcagcatcattcttgattgcaaattttgatcttttaaaatgaccttgatgcttgtatagagctaaaaagtcattaagacaccaactctgaggaataagctcctgagaatgtgttgcatctgtgagtttcagttgcatagctagtgtcatagcgagtggatagacgttctctgtgcatgtccctacaatgcttgtgagttatgacaacactgtgtacgagcaacatagtttctgcagttgaaaagtacgaattcatagaatgtaaagagatagtgtctatatcttttgactgaaaacagaaaatgagatataaaggaataagacctttcgacatgaaagtaaccccacagttggaataggctagtaagctttccaacatgcagttttgaagctgagaaagacgggtcctctcatcagggtgctgtggaagatgatagcacactggggggcgtttagagcaggtgagtgctgttttcttccaacccagtttttctgccactttcttatgtttttgtgaaggtaattttaaaagcagatgtctaaaagatgtttggtagtgatggcattactgcatgtgtcatcagttaaatgacagctcgggagcacagcagttatgttcgtgtgtatcttgggatttttgttgaagaggaaaaaggcagttatgttcatcatgtaggtcaaactttaatgccaatactggccaatattcttgcaaatgacagccatgtaaaatcagggcatagctataaaatgggaacggtgctcacagctggcttctttgtggtgaggacagctataattggtgaggcaaaaccagtgtgccacaaaagcagaatacattctgctgtgcaagcaatgaccagacagactagaatgaaaaggcaagagtttcctaaggttacctggaaccccttgccaggtgttgcattaagtttactggcccttgccaacattcttctaatgcttcctcatttcatctggcttcttggcagtgttcagtttttgtggtcttttatttttactgtttgacttcatttctcttcttagctctgtaaagttccacatgtgtttatctttgtggtgaaaacacaataaacttgcttaatataatgttggaagtattaatccattgtattagtgtgtacaggacctggattgctgataaaaaaataactagcaataacagcctgattgcttaaaaatatttagtaagttttgtcggggtggattggggcagggcagaacttttacattaaatatagatgcaagatttgataagaatcagccagagtgtacagtaagtattcacttaatgttgccaataggttcatggaaactgcgaatttaagcaaaatgatgtataatgaaacaaattttactaagggtttattgataaaaacaagagttaagttcctatggcatatttctgggcacaaaaacatcaccaaacttctaaataaagacccaagacacttctaatattaaatattgatgtaaacgtgagatatgcaaacatttaagcaagattaatacaaatatgataattattggcttggcacagtggctcactcctgtaatcccagcactttgggaggctgagacagggagatcacctgaggtcaggggttcgagaccagcctggccaatgtggtgaaaccctgtctctactataattacaaaaaaaaattagccaggtgtggttgtgcacacctgtaatcccagctacttggaagagtgaggcaggagaatcgcttgaacccaggagacgaaggttgcagtgagccaagatggtgccactgcactccagcctgggcaacacagtgagactccatcttaaaaaaaaaaaaaaaaagaaagaagtaattatttttccacttattccacttcagggtctcagggggccagaacctatccctacagcttgggatgcaaggcaggaaccagccctggaccgaatgccattccatcttggggtgactcacacacacactcagactgggaccatgtagacatactgattaacctaatgtgcacatctttgagatgtgggaggaaactggagcacttggagaaaacccacacagacatgaagagaacacaaactccacacagataatggccccgggctaagaatccatttttttcttgtcaacattataagaaagcgacattgagcataaagacattatttgaggacctgctgtactatgtacttagagagataggcattctatcttgagttccttttttttctcccttcttgaaggaaggttaaattgcatctgagatggctcttgaaattgatcaggggttcaagctgacttgcatactctttgggaaagaatttagaaggatgtgtatgaggaagttcttatggttaagcctgtttcctgacttgaatagatgaatcaaatattttttactattctggaagcatcgcattctggaaagaaccatactatgtcatctcagtctacctcactccattgtaggcacttggaagctgaagttgtgatttctccaaaattagatagctaattttcattggtgttagaacaaaaagcgctgcctctctttgaagacaccagtcctccaccgtcctcctctgcaaggccgttttccccccccttttttttttttttgagacagagttttgctcttgttgcttaggctacagtacagtggcacaatctcggctcactgcaacctccgcctcctgggttcaagcgattctcctgtcttagcctccagagtagattacaggcacccaccaccacacccggctaatttttattattagtagtagtagtagtagtagagatggggtttcaccatgttggccagaatggtctcgaactcctgacctcaggtaatcctcccaccttggcctcccaaagttctgggattacaggcatgagccactgtgtccagccaatttttctgtatttttaaatgaagatgtgagcagcctaatgtaagatcacaacatgtgattcaatacagccgtggcttggtgttgacatgttattaccagttgagctaatccatgtaactcagcattttatgctttactaagattaaaatgatgtgataacattaaattttgaattacagttgatgttttttatttaaaaaacatttttcttagttaaataatacatgatggtttaaaaatcaaatattcagtgcaattcttctaaaatctctgcaagtgtgggggtcatttaattgctgagcctcccagcctattagctttccattctgagctttcaagagatggtggcagctggcaaggcagttttgtctgggaaagccattgttaacagagcagaattggggatggagcagccatagcccacccaccagagtaggcacaaatcagacctgaacgttatcacaaagtccaagttggctcagacatttgtgttaaatcataataaatattttagagaacttggttgcaaatttacatttgatctcagtcagtcctcttcccctatctctacaagcttacaaaccgcatgggtgtgtgggggtcttatttaatattgcgaacagctggttcctgtatctgaagttcttgccctggagcctgggtgtttgttgtagttctgcaccatctgccttggttgataaggcattttggaggccactgattttaggcagcagtgttgttaggatacggaaacagcaggatgtttgtggattgagccttttcagctgaatcttctggccagttctttctggctgtgtgaagttgtgtcgactacagagcaggatgctcatgttgcctgctgggctctgttagggtggccagacgtgcttgtagcagccttactgccagaggaacgtacgttggcatccagagtccagtgctgccgccagttgcagtgcagcaaggctagccccaaacctgatttgctgcaaggattagctcaactctagtgacatttattgtgttttctcatagcccaaatcacagccaaaaaaaaaaaaaaaaaaatctagggttgacatttttaaaaatttttttaaaaaacatttttcttggttaaataatacatgatggtttaaaaatcaaatattcattgcagttctaaaatctctgcaagtgtgggggtcatttaattgctgagcctcccagcctcttagctaaaaaatctagggttgacatttttaaaaatgtattcaacagagtacgagggaaaagattaaagatggtggatggaaaaccataaaagctgagaggaaggcagcactgggcttagagtcacttggcttccctctagctagtaaataaccagcaccaaatcacctgatcctcctgaacttcagtttctgtggccatgaaataagaggttgggtccaggaatcaatgtaaattgtcaatttaacatttccctttattgatattactcccccctgggcttgataatttagttataattcttcatgcagctttaggttgagtaagtttggtgggaaacagtagctctcttcatatatttgagagatgtcatttgaaaggggtagatttattcagtttaactccaagaagcagaaatgggacccatggtagaagctaccaaatggaggtttggctctaaataagaaaacgatctttggagtgcctctcctagtttagatgaaaaaaattgcatcaagttgtaaccatgctagtcattgggaattttattaacaacacgtagctcctgtcctggggaggctcatagtttgataggggtaagatggaaagaattgggcagatgtggattatgtcttagcagtagagccaacagagtatgttgggggtgaaggggtaagagaaatcacatacctcctaggtttttagcattttccaaaatgaggaaaatgggtagaggcatggacagtgacttatatttagacgcgttaagccagttgtaactgcttgacgtctcagcgggataacaagtaggcagccatgttgtgtaatggaaattccatagctgtagcctttactaatgcgctctggaatggtctattccagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtaagcttcattgggaagcatctagtcaacctcacccctcattggtgattggggagaagtgtggaattaaaaaaaagtcaagtctaattttagtggccatctcccttcttttcatcacatcttaatctatttccatataccttacttaatagacatgagtttcaccacctttcatgattcctcttaattaaaattcccagaaggccgggaaataggaagaagacagaaaaacccaagggttttgttgcctataaactagataatgatttgatgatatactttgaattaaattataaactagaaactaattgtatggcttgtctctgggtactctagggagacaacatagtgtggggagcacagacttcagacaggtggtcttgggcttaaatctcaggcctgccacttactttgcagtgtgatcttagacaaatgcctcaccctctctgagctccagtttctacaagtgtaagatgtgggtgctgacagtggatgttgtgaggagcacacagcatgtgtctgctatactgtaaggccttagagagcgggcaggattcactgttttttcagtgagatctgccagcccaaactgttactggtccaagaagagataagtacagaacttgaaactaagcttttggaaatgtttccagcaatgtgacacagtgatcctaattaaaaatgtggacttatattttgtccatctgtttttttttaaattttgtttttctactaatttatttttactgtatcgtataaaaatatcagcctgtagtagattggaaaatttttaaaaagaaaaaaaattgatgcttcacagatagtttgagaaccgctattttgaagcttaccttcagtcattattagtgttctagtcaaacaatgatttctttaaaaatatatgttaatgtcttctggcaagagtaaaagcctgagtctaatctgattctatgctactgagttctggttgagctcatcatgaataaccaggtgttctgaataagggtttcaagtatgtatagaatgggtttttcctgagtttatcagttgtgcagtgggaaaacgttgtatatgcactttttcttttttgagatgtagtttcactcttgttgcccaggctggagtgcaatggcgcgatctcagctcactgcaacccctgcctcccaggtttaagctattctcctgcctcagcctcctgactagctgggattacaggcgcccggcaccatgcctggctaattttttgtgggtttttttttttttttttaagacagagtcttgctctgtcgcccaggctggaatgcagtggcgtgatctcagctcactgcaagctctgcctcccgggttcacaccattctcctgcctcagcctcctgagtagctgggactacaggtgcccgccaccatgcccgggtaaattttttttgtatttttagtagagatggggtttcactatgttagccaggatggtctcgatctcctgacctcatgatccacccaccttggcctcccaaagtgctgggattacaggtgtgagccaccgtgcccggccaattttttgtgtttttactagagacgggttttcactgtgttggcaaggctggtcttgaactctggacctcaggtgatctgcctgcctcggcctcccaaagtgctgggattacagatgtgagccactgcacccggcctgcatatgcatttttcatctctaggagcataaatggaacaaagcagtgttttttactatagttttttaggcatttttaaccttttctgaattttgacatcaattttagtaatcatgggaagttattgtttgttacgcattttccctttctatggataaggaaacttgggcttagagcagttgaatagtggcttagggccacagagctgggttcacaccaccgtactgcactgcctcctgttgaacaggatctccaggtgcttatctcagaacacgtatgcagtggtgaagaccgaagttctggatggacaccagctttcagtgtgactttagcaggtaccctctttctgggctcttgcccccttactgatagaaggagagacttgcactgagcagaggatcttggagctgtcttggagttctaatattccttgcacctgtactttttcttgaggtttacctttacaccaaatgaccccaaattgctgttttgaaaagggagaaagcagagaaaagaatgagtctgttcttcccccattcacagttgcctagatgatcaccttcaggtgtctttgcttctgcgaaaggcaaattgcatgggtctgtgacagctattccaaatatttgagcttcttagaagcctggcacctggatatttgtttttcactgggcatattttgtgggggctaatagaaatactctaggaatctggaccctgggtagtgaaagttgggcacagatgattgagcattctgtatactggagtgagctaaggctgacctggaatttccttatgtgttgcctgactttgccacatcactttttactgcagaagctctaaccataaagggggctttgtcagtcaggtggttttaacacattaagatttaacaactccaaacaaatgagggcggtctattttgtggttcagaataaaaatgtgaatcaaaaaatttgagcctaaatttgaatcatatctttgacctttgaagtagaggccaactcacctcagagaccttgtaagagaggacagttgtgtggattaagaggcccttcctcatagtgacataaaagaccctgaagtgatggaaataaaggaatttataaaattttcccagttaaaattagatgaggggccaggattagggtatcaatttaggagaagataacataatcctatgacattatagataattcagtttagtacacatcaaaatgatttctctaaagatatctagatagaaccttataagctggaatgtcttttttaggaatgggattgcagaggggctgcctgggctgctgacagtaggggccagatgcaaactctgcttgcctttgacccggcaatgccatttataaaaacttactctagaaactaatcagccaaaaatgtactgcagtaagaatgcttattgtgacattgtttaatagtcaaaacaaaacaaaaaacccaacatgtgactatcccatgtcatattccttgaaaatgacaccataagtagatctgtatttactgacgtaaaagatgtctaagttgttaaatgaaaagagtacagcatggtctcctgtactgttgatatttccatgtgcgtatacatggaaaaacacccacgatgcagatgtccaggttatagacaggatgaccatagggcccaacctggcatagccctggtttatgactcctgtcctggcaaaattattaatagccttcctcctcttcactgtcaaaagcttcctgctttggatggtaaatatatgcttattctagttatgggtggtttttcactttcttctttatacctcttgcatttcagaggtttttttgcaccacttttaaacagtgagtgtatattattttttaagtgagtaagaagctatttacatgggggatggaggaatggcctcctgccctcccagaccctgcctgcaagccgtaggtgggctccactgccaggtttctcttgggttaggagtgaaggcagcaccatggtggggaagggcattccaggccattcttagcaaaaacattgggtccaacctgcatgatcctgtgctttaaatcacagaatctaagcttactcctgaataccacaatatctggtactgtccagtgacacagccaatattcttttctttcaaaaaataaaggtctgataagacaatgggaatgatttagtaataggaaattggacatttcataacttgggaaaatttcccagtttgagaaaaagtattttgtgaaaaaaagccccactataaatcacttatcatgctgactgttttctagcccacatttacttctcatcagcatttgaagtatttgtggggagggtgtgcgtgtgtgtgtatgtacccaggatatatctatgagctggaatagcagagggagacaagaaatagaataatagtagaaagcagagatcagggtatatttgcttcctgttgctaccataacaagttactacaaaaatagtgactaaagcaacagaaattcttctctcagtgttctggaggccatagctccaaaaccatgccgttagcttgtctgtacttggcctcttccagcttctggtgtctgtcagcttcctagacttgtggtcacggcactccagcctctgcctccttggtcacattgattccccttctcatctcctcctctgtatgtctattataagaatgcttgtcactggatatagggcccatctggataatccaggatgctctcctcctcccaaagtccttacttaattatatctgcaaagaaggtaacattcacaagctccagggattaggaagtgaacacatctcttttgaggggacaccattcaactcactctacagggtcattatattaatgctgagataaaattacagaaggtataggatgtggtcatggtttacaggggccctgtatttcttctacaggccaacttaaaaaaaatgatacgtgaaagggaaagaagaaagtacttactacacagtaagtatttccaagaggtggcccagtgagacttttgaatctgttaataaaatgattactatttggttcaaatccacagatggttattttatcattaattgcaagataggaacacaaaatattttttctctagtccccatttgagtagcagccttgtttgacatttctgacatggaggacaccaagagaaaatggcagtcagcatccctgggctgtcactcaccggcctaatgacctagggcaagggacctgttctcactgcctctcttttctttaccatgaggataatcatgtttcccttagagggttatgagtatggtatgggccaatacacataacgtgcatggaatggcgatggtgcatagtggcctcgcaatcagtgctatctgctgctgctacctgccagagcagaaacttttcccaaaggtggccagagacagaaaccagagaaaccatccttctggacaggctgtctgagtggcagggcagggtacaaagcggccactttttttcccggatggaaagaaagatcaatgcctaacttggaggcttcctttctcccaaaagacaagaaagacttggcatcttattcttcagtcttcttgctctccccctttccacctttttggccttgtaatagctgagtaatgagctaaagaattttggttcaaaactgtcaccttttaaaattaggtttgccctaaataacatccttgactttaagagaattttcttaagttttagacatttttaatcactgtgagtattcaaattaatcacatgcaaagcattagttagaggctcttggacattttctgtttttagagctttgttggatgctcacatggcaatgtctgtgcagtcagttcctacccagcctctgggctcttcttgcagcttatcttgcagaaagaagcctcatcagaattccagaatctcagctatgattagcttactccacctcagctcagaaacatgcatgattccctggagctaccaaacgtggggcaggtttcttgccgtcaattttgcctctcacaataacccttccagccttcttgccagctgctctcttccacatgcacccttgtgcctgaggcaaactgaatcactctcggttccctctctcttgtacttttctcttccttttccctcatccttaaggctcgactcaaatgaaggattctgtggaaccttgattgctcagttagaaatgagcaaactgtcgcaaggacagaaaaccaaacatcgcatgttctcactcataggtgggaattgaacaatgagaacacttggacacaggaaggggaacatcaaacactggggcctatcgtggggtggggggaggggggagggatagcattaggagatatacctaatgttaaatgacgagttaatgggtgcagcacaccaacatggcacacttatacatatgtaacaaacctgcacgttgtgcacatgtaccctaaaatttaaagtataataataataataataaaaagaaatgagccagcttctctttcatctgagctctacttccttttgattctctctgctttctgagatcacatcttacatgacaatttttcatacttggctttatttccctagaatgttgttaattggcaccaggttggagctcaggtcgtattctttattccttgcagagtctgacagggtcagaacatgataacacatttgagaagtgagaagaagggaggaaggggccagggaagtgaggggagaatagggggtggaagtaggggaagaagcaaatagggcaaggttttagttgcctcccttctgttcttatgctgttaattaataatggaaccagtggccaggcatgatggctcatccctgtaatcccaggactttggaggctgaggcaggagtatcgcttgagcccaggagtttgagacaagcctggacagcatagtgagaccctgtctctacaaaaataaaaaaaaaattagccaggcatggtggtgggcacctataatttcagctacttgggaggccgaggtgggaggatcattggagcccacaaggttgaggctgcagtgagatgtgattgtgcctctgcactgcagctcgggtgacaaagccagactctgtctcaaaaaaaaaaaaaaaggaacaagaatttggataaatggaacatgaaacacaattcatttttattattaagttgtattctgtgcataaattatttccatgtcttctctcccttttaaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttggtaagtctgtgccatcgattggagatgacaatggaagtttcactcacatgaaaaatctgaagagactgtccaagttatgtattgacctgcctttaggtttagcaatcaaaatttactactgagacttttaatttaaaaagccctagggtaatcacaaatgtcatcttcaagcatataaaaatctctgtattttcactggggagcttgttaactttgcttggcatggagggagggtgttcattaaggctgcagtcataattgtggttcagtccagtaactcaaatattgataggaggtttttacagtcaaccgaaggaacatcctggaaaacgtatagatgttcagaaccgaggcttggtttaattacaggagccactccctcatttttactgctcacaaacagaattcatcagaaaaattgtagaaagcagtttgtgtgtgtgccttgaatgattttattttggaaactgggtggcaccttgtctcttgaatagtttttaaaataagaagatgggaacaatatacagtcagccctccatatctatgggttctgaatttggggactcaaccaacctcagatggaaagtatttgggaagaaaaatcaatgaaaactaaacaataatatagattttaaaatatagtaactatctatgtagaatttacattgtattaggtgttataggtaatctagagatgatttaaggtgtgtgggaggatgtggccgggcacagtggctcacgcctgtaatctcagcactttgggaggccaaggctggtggatcatgaagtcaggagatcgagaccatcctggctgacacggtgaaaccctgtctctactaaaaatacaaaaaaattagccaggcatggtggtgggcgcctatagtcccagctacgcaggaggccgaggcaggagaatggcgtgaacccaggaggcggagcttgcagtgagccaagatcatgccactacgctccagcctgggtgacagaatgagactctgtctcaaaaaaaaaaaaaaaaaaaaaaaagtgtatgggaggatgtgtgtaggttatgtgcaaacatagcaccatcttatagaagggccttgagcaccgtggattttggtgtctgtggggactcctgcaacctatcccccgaggatgccaagggatgactgtattggatagatttgcagttgccactgtgaaggacttgttgaactggggtgtgattatgatgcacagagggccctcctgacttgtcagtggccatgcacagggccaggtggcaatgcactcccgtttgcctgccgcctatcacccaagctgctgtctctactggtggtgagctggctcgatgtggtaggagatgggccctgctgcttttagagcatgtggccctgcttccagaatacctgttctggttgcagctgctgctgctgaaggctccacagaacacacagtgctttggggccctgcggtggcccggttctctgattgttcctgcagccacgacagaggatgcagtgtgagccgcatcaggcagtatgaagtcctttcctctcaagccacgtagctagccttaaaggttaatttcataacccttaaggttatttttttttttaatttttttttttgagacggtgtctcgctctgtcgcccaggctagagtgcagtggtgtgatctcagctcactgcaagctccgtctcctgggttcacagcattctcctgcctcagtctcccaagtagctgggactacaggtgcccgccaccatgcctagctaattttttgtatttttagtagagacggggtttcaccgtgttagccaggatggtctcaatctcctgacctcgtgatcctcccgccttggcctctcaaagtgctgggattacaggcgtgagccaccacacccggccccacttaaggttattctttagcttgaacatcatctctgagaaactttccctgactgtggtctcctctcccacctcaagactggatgaggtgtcttgctaagccccctgtagcaccccacactctccccatggtgcgtatcacatttctcatcatcaccgttatctgcttattatcatcactgctgctgcctaacttcaccttgggccaaatgttgtgcaaagggacttaaactcctttctttaatccttacaacatgatcaggtagatgttgttctgtttctctttagagttgagaaaatagaaacagacaggttacgtaacttgctgaaagtgacacagccgatttgccgctaatcagtgtgacttcggaagctgcacttttttttcaacttttattttagattccaggattgcgtatgcaggtttcttacaaaggtgtattgtgtgatgctgaggattggagtgtgattgaacttgtcacccaggaaccaagcatggtacccaataggtagtttttcaacccttgccttcctccctccctctccaccccccaggagtccctggtgtctgttctcatctttatgtccatgtgtacccagtgttcagctctcatttctaagtgagaacatgtgatgcttggtttctgtttctgaattagtttgcttagggtaatgacctgcagctgcatccatgttgctgcaaaggacatgattttgtccctttctatggctgcagagtattgcatggtgtccatatatcacattttctttatccggttcactgttactgggcacctgggttggttccatgtctttgcaattgtgaatagtgctgtgatgaacgtgtgagtacatgtgtctttttggtaggatgatttattttgttttgagtatatactcagtaatgggattgcagggtcgaatggtaattcagctcttagcagaacctgtatttcttactccacctcccccgcctgtccttagtatacagcagtggctctttattgcctttttcccttataggatacagccctctgcggactgggctggggctgtttggccattataccctcggcttctaggacagtggctgtgacacagcagatgctcaaagaatatctttaagattcagagtgtgagacactgcactagcaccgccatctcatgggccctcacaacagccctgggaaggtggcctgcaccctctctaagaaatgaagaaactgaggtcacatgttgaccatggtcacaaagtcacctgaggggaggtgacaggaactgaacccactgtcactctgtgtttccctgggaccctctgagcgcaggaggcccgtgttgctgtgcagtggcaggccaaggcaatgccttggtggagctggggcccatttggcccactgacctgaggaaagcagttttgtgaattggcagtagctgcatttgctgacatggtgagttacaggaaatgccatcatgttcctatcatgtgaaacaaagtgagaaataggttcagggtgggaggctgaaagggaggaatgcagacagccccgctccccacacttgctccaaggctgggaggaggaacgggaaggtgtctcccctcctggattcagtcaccttcttctcttcattcccctgcagtatcccctcattcttccacggacacgatcagcccctgcttcttgttgctcagatgtcatcacttttctgcagagggaaaagaagagaccagatcagaacaagggcctcggcgtggctgtgcactccgaaggcactgtgtgtgcctgagccccaccacggcctcccctgcagggctcaggcagccttccttgagctggcatgaggtctgtgggagcccggtccactggcagggctggctgcattcaagtcctctccatccctgcctctccccaccctctccctctgctgcccccttctctgacagtgctgacccccctctctcttccccactctttcccatcctcgcctggcctccggtttggatgctgtccacacacttcccgagggcctgagaggacctccgtgtgaggcaatgcatttcccaggtcacctctgtgtctctctccaggctttttccagggactccccggggtcagtctcctctccccactggaacggggaaactgggattggcctagacccggcagtggagtcccaggtgccctgcctgcccggctgactccgcccagggaggcctcccacagaagctcctccagactccacctgttacctcccccactcctctcacccaaggctgtgctgtggccaagtcagttgtttagtctacactttctgtttagtctacaccatggctacctcaaggcccagtgaaggtgtgtagtataaagcaaaatcaaatccatatttcagttttccttaaaaagtgaccttcatattctggccagaagaacagaatggttggttggatatattttgagttttcatgggtttttgttttcctgcctcttgttatactttctgaaattggcttttagtctaaacaggttttttttttttttttttttttttggcaatgtgttttcctccaaagagtaagaataataggcctcatggctgggtcgtgttctacagtttgtgaatattttctcaacctttgtcaaatttcatctttacacatcctgtgtgaaattgggcacgtgccgttatttccaacttagaggggatgaatgagcccttaagagcttgagttctctgcccacattgcgagttactcagtgccagaaggagttctggaacccaggtctcctcagtctccataccacatcccttctagggcaccatgttgcttctgtgtttcttggctctgcccactccatgccagcacaactctccccacccctgctttggtggaatcatgttcctttggggtagatcacaccagccagaggcaactgctctcagcttagcagatggtactcatcacattattcttgaagccttgggtcaggagcctgccccacccatctgcatccatttgtccagccctcagacaattgccactgttttcatgtctattctttgactctctatcctgggtagacaacatggactgcccagcatcctgtcttctgtctggggctcccactgtcgtcctgaccacgctgggggctgccagtgacactgggaaactcctgagggacccccttcaggcttcacatcatctgctccctccctagcatcccagcctagaacactttccagccatcagctgcattccccagtgaggcgtgcagcctctcccatgataggagggcttcagccgaaagaacacttcaacaggcccagaaacccaggagcaccattagatcagaaagcagaagcaagaatgcatctaatctcccccacatcaattgctatagttttattaatctgcatattataggtcagtaaggggatggcacagtttataatccctgcaagagtctgatgatcttttggtgaccagaagtgccattttttgatgggcttctagagatcctccatcagggataccagacatgtttggcatgcctgtgctgccgcgagacgctaagcgtgtgtccagactacacgtgtgggtcacgggtccagcagcagagctgtcatgttgattgtttgcttctactaaatgtataaagcctgcctggtgtccagaagaaaagaaactataatccaattttttagaatccataaaaggtaagaagtaggagaacatttagaatccacaaaagatgagaagtaggagaacggttggattttttagaatccataaaagatgagaagtaggagaacctccaaaaggaaggaatcagctgagagtattgaagatgaccaagtacaaacaggcagaggggagcgcttccccttctcctctcccaggcggtgggctgcctcgctcggccaggacacacagagcagcatcgtgcactttgaggggcaggtggagctgctcatcactagcaggggtgctggcggggaccacagtgttctcttccatctttgagttgaagtcctgtgtgagaaatgagaaaccttcatggcaaaagacagaaagggacctagaatgtaacattcagcagtcttgttatctcacgcacctgtctgtccagttggggacgttgctgtatggaggtcagttgaacaatcacagttgaggagcctaatgaattcttgcaccaccagccacacacattattctgaagagtgagccattgtctctgatcttatcaggatcacatcgtgggatcatatttatttggtcattctgaatataccctttaagtccaaagtgaaataactaaatgtcgttgataaaaggaaagaataaagtggggtatgatttcctttcacagaggtctggaatcttcctgcctttttcaagtcagtcggtggtgctggcaaatgtttaataaccagctcctctcacccctcagaggaagcccttggtgttcagtgtttgcagatttccattgtgcaactagtcctcccacaccccattttaaactacccacttgatgtcactggtcatggagttgggctcacagagccagtgggagtcaactggagcagccactggactcattcaagtgtttcccaaaaacaatctgctcctagaaggactctcccttaatctcctaaccctgccattcaggatgattccctgcactctgggaagcacacgttctagtgggaagactgatactgggcaactgataaccaagtgacttaaacttctgagggttacaaagggtgtttgtatcctcagtgtctcatttcagattctgctcagagctaaatgcaacaatgtgagaagatgttagtatcccagatcttcatccaggaaggaatcttagagatcattaggttgtagggtttctcttctgcagaggagatagagggtcggtgtcagattgctggtttgccagtaccactccctggagaaaagagcaaaagaaagaaacttgttagtcaactgtgcagagccaccgtgagactgaatagctttgtgggtggccccgtgtttgctgcaagagacctctggcctcttgtagcagctgccacatggtaaacagagccgagatatcaggagtctcgctgaaaatgcagtcagatgggctctgaatagaggaaggcaggacactcttgagatgggatggggtttctcacagcaccgtacagggaccacctgcaagatctcttgaggggcttgtgaaaaacacatccctgaggtcaccattcttgacctgctgcttattgagtttctgatgcctgggatgtgcaggtttaacaagcccccagatgatcctaataggattcctgcctgaaaattgctgggtgaaggctcttccccctccaagtgataaagaaggaaaagattgatcctggaagaacatccgttagatgagcaaaattttgtggagcacttcatgaagaggaattactaggtcatttagaaatatgtttgaattgtggatcatcttgtaggcctttctggcatatttctccacttagatccacaagacacatcgaatgtctttttataaaggggttttttaatgcccatgtttgaccctctccacttaacagtcccattctcattttatatgtgaaggtaatctgctttacagaaaaatgtaaaggacctgcacttctctgctttgtggtaagttgtaaaatgcagtttaaagaggcaggcctcatatcctgatagatttgtaggaaggattgcacagttttacccagcttccctcgagtttggcagaaattagctttccctgagctggtgtcttcccgagctagcatgcttctcctatggggtgtgtggccttctctcctgtcttcttgaggcagagcttcaatctagaatctgttcacaaactgaacaaatgcaacaaacagtaaacagtcttttgctcatagttaaggtgccttgagttgggtgtgaggggctgagtgtgttctcaggggtgctctgcccacggctccggccaactgctgcaggtgcgcatcatatgggtggtctttgtggaatgccatcagcactagcttagtacctcctaaatgggagctggagggctacagtgctcaacactggattatacgaatgtggattgtccaggaaatgcttttaatccccctcatccactctctacccacgtgacctgcctctccctctttacttggtgtttactcaggaatgtgggtgagttgtcgtgttagcctagaacagccattcccaaactttgatggaaggatgccattcactttgaaaattatcgagtagcccaaagagcttctgtttccatggataattcctatcaatatttactatattaccaattaattaaaactgagattagtatttatttgattcgtatttatttttacatagctataataaactcatacatataaaaaattattaaaaaatgactgttttccaaaataaaattagttagaaatgtgacattgtttctacatttaaaaaatctctttaatgtctgatttaatagaatccgctgaattttatttgcttcattcattctgttttgcttgttatttgaagcatataaagcaaaagctgaccttgcacagatctatagtaggaaaagcagggggagggcctcatggacccctaaaaggatctcagcgacctccaggggtcctcaggctgaccaaacattgagaactattgacctggaagaatgtaaaataggaaaacagtgtctcccccaatagaatttcgtgtaaaacgtggactgtgttacaaagtcagatgggtgcagttgtcctgcttaaccgctaatcaggagctgaaggccagagactcacagctgttccccagcctggtagtgaacccagaggcctgtcttgctgtgcagtgggacaggaagttgcatttgggagtctcatagaacacactggaagatgtgttttagcttggccagtttcatgcaggacagattttctgcataaagaaaatcaatgacagtttctgaaactgcatcctggaagccttgaccagtttgggtaataacaagagatttgaaagtgtggggtgtacaggtgttttgctgaatctaggtggtggtggtgattattattatttggaattcagctttcagttctacctgcttgtgagttccaaactttgtgaaaattagttgcttggacgaaacttttctttgcctctggaaggctgtcagaaagcgagatttcccagcttatgtgcagtgttatagttaatagagtaatggctctgcaaagttgttcctttactttaaatgtaatttattttgcatttgtgctacagaacggtcataagtgtgcccttttgtcctcttgtttggaaactgggtttttataatgtgtgtggtctatccgaagattattgcccattattgaacaccattcatagcaaccatttgcattaggcattgtacgtgtactctccactctgcaaactatgtgttctgtccctttttaaaaagaggaagctaaggttcagagaagctaggtagtccattctgagcttcacgtgccagaggccattttgtacttacttcaaatgccattgaaataaatgcacatcagagaattgttcttagcataaggggcgctacatgtaactttttattagtgaaatggatgatgttcaagggctgtggttgattagaaaggcgtccagaccctggctccagggactatggagcagaactggaggccagtgcctgtcgagcgggtccccacactccatctgtgtgacctgactgtggatggcctggctctgccgttagattgccacggtgccctcctctggttgaacctttctcgagaagtgcttgttggaggcttgagtgcagagcctgtgagaagctctatgtggttcctattgcctgtcagcttgctgataaaggtcattggtttggcaaaatttggcccaaggtttgccttctcataacataccactcggtagcaaggctgggaggaaggtggctatagctatttctggaagctgcttagggggctgcctccccctaaattggtacataatttgcagggcctattgcaagatgaaaatgcagaaccctttcttgaaagattattaggaatttcaagacagagacaacagagcatgaagccttgtgcaaggtccttctaagcacagagccagtgtgaccgcacagaacacacacccgtgaagccagctctgcccccaccatctgaccactcttgagtggccaattagcataggtcactccccaccctgctaggcccaccctcttaggaatgttgtgaggcttaaataagaaatagccactctacaagcggtgtcaattagcatgggctctggtttctgtgtgaggtagtttgctaacatgagagggtatctgattagctaaaacgataacactgacagattaaattcagaataactaaaccttccctgtgttcctttatgccacatgactcctgcatattctgctaccagcacctgtttgataccagacggaggggtccatttgggatgggacaggagcatcagcagaaatgcagaagtggggaagtgctccatcttcttggaagctgagctggcaagggtaatggaatgaaagagattgtgaatatttttgagactatgaggaaaccagtacactggtgttgcccagtacagaagccacatgtggctgttaagcacttgagatgtggctactccaaattgaggcgtgctgtcagtataaagaacacactggatttcaaagacttggcatgaaaaaagaatgcctaatgtctcagtatttttatattgattatgttgaagtgatagtattttgtgtatgttgggtgtaacaaaatatctaattaaaattaacttcacctgttattttctaatgtgggtgctagaaactgttacatcctgcatgggggtcacattccagttcagttgcatgtgctgctacccattgttctacacacacacacacacacacacctgcacacaacctagaggggtcagagaccccaggagcccctgcttctggtgcccaggctaagcgctggagtggaagataaagctgggagggtgggtaaggaggtgagtgcacggagctccaggctaacagagtggataatttgttctttgagcactggggagctatggattgcttactagcagcaaggtgacttgtgcagggtatatctgggggagatttactgggggaagagatagaggaggcaagaagtgaatacagaacgagaaatcaggacagtggttaggagaccgtagctttcctcttgagtcaagttcagataacacatctggactgatgaaattctttttcaggaagctgaggaagagcccatgaaaatatgttcctccctgtgctgagaccgaataattgcagtgaacaattaacgtgtggcctagatccaccttttgccttcgctgatccaagcaggttcataattcttgcctgggcccaagcttggccctggctgccagctgcctggctccagatgtttcttaatcgtttcaagtacttctctgctccctggaaacaggcactcccatcagtcacattccagaggaggaggaagaggaacttgacaagtatcagctacaaaagcctcctgaacaaaagaaatcctttaagcctatttgaataacagttttttgtgaaaataatcaggatgttgagagcttttttttttttcttttaaactctttttggaaggtaacttttgtgaaaagaaaacacctgctgctcctcaggctgtttcaaaacactgcctatagtttgaaagtacggagatatgcatgtggtatgaagcatttgcaggcataatatgtgtagtctgggaaaagcagatccagagagtgcttgtagtaaggcgaggccttttagctgcatttagatgatgctgggattggggtgggtgcagggtgcagcagtggggaggaagaactgtgtgtgttcctcttgagaataggggttatgtctagaggattaacagttttcttttttcttttttttttttttttttggagttggagtttttctcttgtctcccaggctggagtgcagtggcatgatctcagctcactgccatctctgcctcccaggttcaagcaattctcctgcctcagcctcccgagtagctgggattacaggcacctgccaccacgcctgactaattttttctattcttagtagcgatggggtttcgccatgttgggcaggctggtctcgaactcctgacctcaggcgatccttccacctaggcctctgaaagtgctgggattacaggcatgagccaccacacctggccaacagttttcttttttcgattgaagttcagctatttgcaggaccgaaggtagttctgattactttcacctgtacttccaccaaaaaataaataaaacaaccatgagtaattgctgatttttaattgaaagcattattccaggaataactggtggacttcgtttgcagaggaagtggcaaagactgattgatattatgatccagcttctaaagattttgctgcttaatctgaagcacattggatttctggttcaataggctttctttttttgtttttattattacaactaatatgtattcttttcacagggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacaggtatagagtgttccttatgtctttaatacaacaaaatgctaagaatgtttcttatccctctccagatgtgcctcaggagctttttcaccgtcaggtaacattgtaatagctgtcactgctgataaaggactctgtgctaggcattattccaagcgcttcatctgcacttccctctaaggaagacactgttcatcgtctcaatttgtagattggaaaactgagtctccaagagattataaattgggcccagtcacacagctagcaagtgtcagagctggactggaaacccaggcctctctgactctagggccttccctcttgcccccatcagccatcagatgatctcagacctacctcccagcctctgcatctgctcttcctctgcctcacccccacccttgtcatctcaggttcagctcaaatatcacatcctgggagaagctcattctgactaccctgatgttgtgttccccacttccaccttgggcacactgcgtcacgttatcctggctgatttcttttgcacaacacagccactgccagaaatgatcttgtttccataatcatctccctgtctattttctgatttttcatagcctgtgaactttaggagagggaagggatcttacgggtcttggagccgagttcctagtttctgaaacagtgcgtgggttgaagtaggcaccccataagtatttgttgaatgaacaattctgtcagagaaaaccaaacacagtagcgtattgcaaataccacgtgctgctcttgctgcctgtcagagggaaaactctggatcctgcttcaggaatattcctaaatgttgcagcacatgttgatatgttcatttactaccagtaagatactatgccttcagagctctagagagtatcctgggagggaatacattagagccaaggacttgctttgagagcaccaaattatgtgattcaaaatcttttcaccttgacctgtgaacatggaccacgtgaatgcaaatatcatagaaggaactcattcactgaaagattttgaccacataacactttccacatgtactgtgaggttcttcctacattccctttattaactttaaagacagtggtcaccaggcagtggaatttttgagttttctataatttatgtaacacacaactcttttggggtggtgcctttggttgattagacagtcttcgatatgggagagccacagctggtgcttatgggattatattatctgagcctctgaaaacggttttgttttctttctctcagtttagataggacatatccaacttggtggatcttagcggattctgaccctctgtaggttgttgtttctttaggctcaggccgtggcactgctcagatctgggctggctctcgggcctctgtgagcctgtaactcttggtggcactactaggaactggcatgagatttctgccagaatcatgtcattctgtgaagttggagttccactttagttggaaaaagtttttatttcatcttaagatgcacacttgtcttcttgttttaacttgccaggtatctggatattccatatattatacaccaaaagaaattatgcttctcctgcctattgagtaatttcaggggtccagagggaacttgctgagtgaacatgtacaatggattcctatggaatcataagatgcccctaattcagtcttagtaaagagactggcttcttatttctaattcctccaggcttgagttgtgcaaagagtatgtatttgtaagagaatttatgaaatgtttgcacaagacagatttttagatcttcttagtggaggaatacaagggaacaataaaaaggaagtggcagtagaagacccagcgttagcgtcctgggcctacacccagccagtgcctggcaccagcaggcacttgggaagcacttgttggatgaattagtagctgagctcagtggatcgcaagccaaatcgaatgtttaaagttctagtaagtcttctcttacacccaccctgtgagcagtaggcataactttattgctgtggcagatccctaattctcagcccttgtggctgtcttcctgcagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttggtgagcattagtaaatctgtttgccagaaccagccttctcttattagaggggaaacatttcctgtctctccgtggtgattcttatttttatacctgtagctcttaccagaacagggtattgtttgatagtctaagattagtcaggggtgggttttgtgactttggagtcctccttaacttctgataatcacggggcttccctagatgccttcatcttgtgggatgtggatccgatccgtgtagatccgatcgctcaccatgagggtctccctagagcagacatttggaggacttggctgaggagccacaggtgtatgtttctcatgaattgccttcctcagccactctgggttgtgagtattgactgatgctgactgtgggcctctgggccctttctagattcccttggcatctcttcctcccctttctcttcttgccctgcccttggctctacactttctcccaagtcactgtcttggagaccagtgtcaggaccttgagtaacacctccgtgtggatggctcgctctccccgctcagccttgacacttcatgaaggcctcttgcccctgagcccacatgtcacagccactgccactcccgtgcccccgctgttaaccttgggtggttcacatgtaaaacctgcctttatattcttgatttactttttgagaacattgtcaaagttaggtgagtgttcatacacaaagccttcaacctgccttcatatgcagggatagggctgtccacgtgcgcatcaggaaccgagtggaatgttgtgagcatggtcagttcgggcacagtttgttttccctactgcagaataaaagtgatatttttgacaattcaggttcttttttttattgtaaaggaggaggctactaaaaaaatgatagttattatatatcaaatgtttttaagcatcacttgacagcttaaaaacatgtgatctttaaaaaatttgtttttatgattagagagcatcttaagggaaatgttcaaagacattgatactacttcagacatgctttgggtaaacatcttaaatatccaaattctagaaatcctaaaatttgctttttaatataagtgagcatttacccttcttctctcttttcctttccccccaaatactagatttttattattcacttttatctacaagaacctttaaagagtttcccattttgctttactataagaattcatattccttcttttctgtccctgaaaaaataaaatcactaaattaaaatagatacaaaaagctatctcctggttgagcatatctttagtgagagttcatgaaggtttataccatggttaaaaaaaaaaaaagattaactaaaagcctcaaaattgtgtgcttagtttattaacaaaagagttacagaaactaaaatctcaagctctaggctttaagctttcttgccaataacttctatgtttttgacttctctaacactggaaattaaaagaaaattattaatctaccttccttacattttctccacattttagctatgattttcatacagggtcatgaagaggagtgaggatggaaatggggaggagggagcgctgtttgttaatggtttgtaaacagctcaggcattaaattacttggttagtgaagaaaattctaccaaggcaaccaggctgaccacagactggagggctgaggggtcatcactgagtcatctctgccctggggccccaggcactggagctgctgcttgcagaaagttctggggctctggaagagaaatttttccttcggctcataaatgggtaaaaagacgttaacaaacaagcagactccactttggaaatgatagcccttctattgcagagtaatttgaagctctctgaagctcactctaatgacttcataaatcaaagctgcagcttgtaaaggtaagatatttttctgtagactttgtaggcagtggtgagactcggagtttcataaacattatgcatagagatgccagtgtctacatcattcctggatcccacagactcctgctgtgctaagtgggtcgttgtccagctggccaagggctcctgggattagaggcgggaagtgggatctcaaggccgcactggcttgtgatgtcactttgcaagaactgcttttttttccacagtccatcccatctttcagtacttaaaaacagaaaagataggtttttacaaaccatttctatttttagcactgatgacttagagaatggtgatggagatagcttagttttatatttcaaagcctgccattcagtcactatagtcttttttggcctagggcccatttcattataagcctttaagtctggataaactctaaaaacatgtagaactttgttgactaagtaaaatatttcagtttgcaccaccttagctcatatattagttaataggttacctggcattaagtatgtatctgctccttggaggggcggctgccagtgatgtgtgcgccttaaccttcacatgatactcacaccttgctgaatggcagttcttctacctggtgtcacataatgtcaatagccccttcctgtatttttctagcttgagtacagcagggccctgggagagacgcttgctctgttcactttctcatcacatctacctttgggggaagaaaaatctaaaaaacaggacctggcttgctcctgatggaggaggaggctgcagtgttcagcctctgatgtttttctataggacatgctgccaaatagatgagggaggaggaggagtataaaaactaagggtttggcaaaaaacacagaagccacctgcaatatagtgaaggcttcagagagactttaggatgaaaatagactgaaaacaagattgtttctgtggccaggaaaatctccagctattcaggtgacatgatgccgcgtgatgatgagtgtgtccagtctgtctgtgctgttgttctgcacagcactgtcatcagccttcagcgtcccctttacccgttactcatagaatgtagcggagccacgactggaggaccgcagccttccagaagaaagttgagaaggctcagccttgacaaagacaaaggtggctggaaaaagagatgcagtgcaagctcacataggaagattgcactttgagatcatgaagtttagtttcaaatagagttccaatacacagtaacgcaataagagggttgctgaaatgtcctcaaagaaaagcagttcctttgtgttgttcccagcgaatacagtgcaaagtaatagagtcagctgaatttaagattcctatttcctgccggataaaacgtcttgcctgtttctaggtggcttgaaaaaggagaggagagaaggaagaggcaggagaaaagtcccactgaaaggacgtgggctacagtgtagtgagctaggctactgcctcactgcgctgggcggctccaacagttcactgtctcctagggaggttttcaaatgcaggacatttgctcacttttccaaggagagttattgtttttttgttttgttttgttttgttttgttttaaaaaattccagaatgtaaatgtataagataccggaagacaggcaaaataaaaataattggtttggggcagtgggtttataggtaacatttttctttactattgttttaaaattagatgtgatttaaaaaaatttccaaagccaaaaaacggtacaaatgctttaaaggatgaagatgttgtccccaagtgtcatcagacaaatttaggaggcccttcctcccaagcaaagcttcctgcagtccttccttcaactctgaattcaagcacattcctgcattgtgcacccaaatgatctcccgatttaagaccccctgtgtctcacagaagcttctggggctgaactttctccggccttggagggttggacgctttgaatgggaggagtggtggtgagtggagcatctctggcagcaggcatttgggagtctctggcaggaatcaatcagcgtagtctccaaaggtggcctttctctgacactaactagcccttgcaggggtcatacccataacctgcatctcattaacatcatctccttaccagtgcactgacctagtgagaaaaggaacaataagcattcagcgactcctgcggtgctccaggggaagttagaattgcttggctggggcagaggcccctggtgatctggacctgcgtgcccccatttgcccaccttctgccctgcacaaccagtgcccctgccttgccagccagactgtttttcaggctcctgcacacctccctgtattgacaccctattttccttttattcagagtattaatcctgaggtctgacctaggaaattttcattggttcttcaagcagtcacctttctgtgggccttttctttcctctttgttctcgtaacaccctgggcataactctaccgaaccagaactccttggtgtctctgcagcgtgttctttgtgttttgctcatggcttaatctccagagcctaatacagtgcctgatgtgtattagatgctcaatagatgctcattaagttaaagtagaagacacctctcagcagagttctcttaaggtgttgtgaatagcattgggaaagaacatttattttttaattacattaaatacaaacagatataataaaataaatcatatgcccagtgctatgtcttaattttttaacatatcaataaagagactttaaaacacataacaccaccctctcccctccaaatttcctttccgggaaagtctccttttggaatcataggaagcacttactaagttgatttattgtaaaaaaaccaagatcctaataaatctcagaagatctcctgttaacctaaagagaccactgatgtggattctgtatttggttgtgctgacaaaagtttcccagtaattgtttattttaattggcgtagatgtggtactgtacctaatttaaggcacttgtccctctgagagtagagaccaagctatagaaaatcactggtgttgtagggaaagcctttccccaggatccctgcaaaaaaggtcttgatttttattctgaaagatgccctcattttttgttcagctataaaagttcatatattgaaaggaggtctaggaagtctcactgtgtaaaccactgaaacttcaaatttactttagagttttgtttctggaaatgtcatttctgtttaaaaatacatctttgttatagtattattttagatctttttattttctgtagtggggaattatacaggtagactacattttataaaccagatatttcagaggaatattcttcaattggcctgccttggtgtatgtaacacttaccctgaaaagctctgatttcaaagacacagttagttctctagtatatcttcccagcctcaacaaccagacttaagaaggaagtgaaggattcatcttccccactttcctgcggccaccctgagccatcagtagttgtgatgtttgtggaaagagtgtggaccctgagctgggtgggagaagcaggctgatctcagcgctggcatggcttagggctgcacccatctcagctcacatggttaattaagggttttgtggtggttacagaggatctcgagggctatcccagccagcgggctcctgggtctgtcatctctgcctgtgctttgttcagaaactacagggattcagtttcccatttgcacagcagcacccagtctttgcttttctgtttcttcgtggcttttaaatgttatcatattaaccatctagagaggcaccctgcaaggttattcctctcacctgcttttgctttccttgatttgatgaaatttacagcttctttctctcttccattatctttcagccaaaagaaacagagaaaagaaatactgacacttgcctccaattatatttctactctgatttttaaaattgtttttttcttatattattattctagttattaggtaacctgcctcagtttagtcaaccaataattagttatcgtggctctgctttaaccccaggacatcgactctttttttccccagcagcttcaactctatgaggaaggtgagacagggctagggttgctgctcggccgcttgccttggccggtgccctccctcttattctgcagtctgtatagaagttgcatccatttgccagccactctaagaacaaaatatggccagaactaggaagtaaccttgacagagttcttgaactcctcagagggaaaaatgttctttattccattatcatgttaaaaatcagtaaacttgtatttaacaaagtacttctgcagttgtacagctgttgtacagtttttaaagatctttgaattctattccttgtttcaaaacagaggaaacagagacactttttcacttactctatcttaatttctgatgctttatctataaaaatcttttagtgtgacccataaaaacatgttttagtatctcctttaaaacccaggagcattcctggaaaaatagactaataaaacctttttccctttcccagtttaacttttgaagcatgtttgaattttattttcagagtaaaacataatttttaatgtttatgtacttttatttgcaatactgtcttgacaacactgtctgagatatcaggctcttaaaaatgaaataaagtttgcaatgtggggctatgtctcccacactcctgctctgtgatgtgtggaaaaggcaatggaatggtattgcgtgagaaactggtctggtttaactttctgcatttctgtgttttctcagatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatgagtcagtccaaaccttgcaaatgcttaagccatcctagatatgtagaaacttaaatctctcttgagcaggaactgtttcctaccactttgtgttctgaacggcattctgcatgatgcctggcatggaggaggcatatcacaaacgtgtggaatgatcgtgagtgtgtgtgttgtgagcgtcatggtgaaatgccacatggaaacatggtggcaatgtttagctgtagaaaccagcacaggttattagtagtttcttacatttaagagacttcagctctagtagcttgttcttctgaaacatatatatatttatgcaatgatgcaatgtagggttttgtacattgagtgctttgatttgtgtgtgtgtatgttgaatggttttaattggaattttctccaaataattctttgataacaaagttatgatagggaacatatattctatgaatttgtttcatgatgtgtgtgtgtggtttttttttaactgaattcagttcaatatctgtggcttcattacctctggtttcagtatacaatagaaccattatcctctgaagtgttagaggctgagaggtgagttttactgggaattacaactaaactagatggtgaatgccctgggttgggcatgggagcagattttgatcctgtacagtttaaggaagaacctgccagtaatggctgctgatgatggaggactatgctccttagtagagaaaggggcatcattggaagtgtctagaggctgggtagctacgaaagcactggaagggatttcatcattgagtcactgcagagtcagcagtcaagcctctcataagcctagaatctgctccagatagtcatgtgtcacttaataatagcaatacgttttgagaactgcatcattaggtgatttcatcattgtgcaaacttcataaagtgtacttaaacccaagtggtatagcctactacacacctacacatgttgttcctaggccctacaaatctgtatgacatgtgactatactgaatactgttggtagttgtaacacaaggtggagtatttgtgtatctaaacataactaaacatagaaaaggtacaataaaaatatggtattctaatcttatgggaccaccatcatatatgcagttcgccattgaccaaaatgttgtaatgcaacacacaactgtgtaacgaaagcatagagcaatcaggcaaaaacaaatggtgaaataaagctatttttgaaaaatccttactctggagatttctgtagtccaaaaggaatccatgattccagtggattgcatccacatgcagtgtttgtgattttcatttgcagccacaccttaggtgttaagcacagaaaaagatgcaaatttggcctgcaaaagaaagaggtttcataccagttgttaactttagatttctgtttgcacattgcatatgcccttatgaaagaacagttcttgtctgttctgcactcatctttaattgagagcctctccatctcttttccttccctggaacactcttcttgatgtggatagctttggcttgttggggccttgctttttgccaggttgggtgggcatcgaaatatacgcatgatcccattcagtgcaggccgcactcctgagaggatataaagtggttcactgactgacccacactcactctgctgcaaagtggaaaggtaggggttcaaactcaagtccctcccacctcaaagtgctttagcagctctcctacactgccaagagcctctggaggtcatttaatttagagtttttccctattttaccaggattctaatactgacttctccacccttttgattctttgatttctggcattttcattcattctttctttcattcattctcttcttacagcttttgttgcatgtacttacttacatttacagcttctagggcagacccccgagagccttggttacctagactgagggctatatccactacctgacatgtcaccttgctcctgtccctcaggccatcccagctgacattgtttacctcctaagtattgagcctcagaaaaaaatcccattgtctcctattttctgtaaaaaacaaaaaataaaacgtattgagaatacttaggatacatcaggtgctgtttcagtgctggaagagtggaaatggacacagcatgggaagaaaatagctgtgcgtgtacctggtttgtttcaagccgctatctggctatttggaagttgccattcatttttccactgactttttttttttttttttttttgagacagagtcttgctctgctacccaggctggaatgcggtggtgtgatcttggctcactgcaacctccaccttctgggctcaagcattctcgtgcctcagcttcctgagtacctgggactataggcatgtgccaccacgctcagctaatttttgtatttttagtagaggtggggtttcgccatgttggccaggctggtcttgaactcctggcctcaagtgatccacctgcctcatcctcccaaagtgctgggattacatgcatgagccactgtgcccgacctccactgacttaataactctaggacataggtattataattcctatttttatagatgaagctgagcagagagtaacatgcccggccccttgtagaaaggcagggtctgtgggagccagggctgtgaggttggagctgaggtgtttgagtccagctggacttaaaagatgacctaagatcggctggcagacattttccaaagaaggccaggcagtatatattttaggcttcacgggtcataacgtcacaactactcacctctgcgacagctactcacctcggcctttgcagcacaaacaatccatgacagcatgtaaggggatgatgggtcatgttgcaaaaatctttattttaaaaactgtgcagcgtgatgggcttggtccacaggtggtggtttgctgatccctgaactaaaggatcacagcatgtgagaaggtacaggaatgagagcagagagcaattctcagaacctgaggtgttcaacattttgggggtatcgggagcacaaaaatttgcatttagggcccgggtttttatcagtggtccttatagaaagtagatctacccgcatctctcccctctttccctctggtgtttctatctgaacttgacatctgagtgttctctgtcaggctttctgctttcctactgccccctcccatccagagggtgctgtagtcttaagttctacacagaaagcagacatggggtccagcatgattcctctgcagccttagagatcccccaggcccaaatcttgggggtcttcagagtagatgtaatggatgcttccattgcagatggtggagcatactgccctgtgtacagatggggtggggcaggaagtgagggcatctgggtggtcctctgtgatagctgtggttccatttcattaaatgccttccctgtatagatagtctcagcctgagcaactgggacacagctggatcctgggtggaagaggtggccaaggacagggctctggagctctggctcaatgtggacaggctgaaagcagccagagagggcaattccaaaggtgacagagcccaggacagaagaccaagggtgtctgaagcctttgtggcagtgtacttaccaaaggacctgtccattgaataaaccatctacatcttctgacccaagaagaatggaaactttgggaataattagtaacaaaggaaaggaggtcagtgttgtattcttgtcacagtgggtgctctgtggctgtgaagtctcagctcagtttaaggaagaaaaagaggaagggtggctgtgggaggcagggcaaatagcctattttcagcatcctttaggctccactcagagcatggcctcagcccagcattgtcatcatatcatgtcagagcttgttagaaactcagcatctggggccacacccgagacctgctgaatcagaatctgcatttcagtgagatcaccaggggattcacatacacacaaacagctgagaaaccctgctgtgggcaactctgttagaaacacaatgaacaaaggagcccctgttccagttgagcttgtaggttagaaaccagggttcctgtattcagaagacacacctcaaatcaggggcaaaggtgcctcttctgcctgtgggggagccgtcacttcttgggcagtttgcaccgtggaaaaggagtagttttgtacgaggacaactggtgccataccaggagggtggggcgtggcggggagaagtggtttaccactggcgttgttgaaaattgctcacatgcagtggtaataacaagcagagggacttttagtgggtttgatgttttttgtaattcactacagatagtgtgtgcccccttgttgctgataccaggccgactgttcccactctccagcccttggtatgacaatgggaccagcagattggagggcagggggttaggaaggcggaagctctgtggcgagttctgcaaaccatcagggttcatgactttattaatcagtgtccatggactgtgaagagaaatgctgagtctacaatagcaaatgagccaagaacataaacagacaattcaccgaagaggagatatctagtaaacaaatatctgggaaagtatttggcttcatgtgtaatttaaacttatgtaacatataatgctttactctactagataatagaaagacatttcttgatgccagtacccagcaccaagggtatactgtatgcagaacattagcatgttgctgatggcagtgcacattgattagtggctgttgggagacaatttggcgaaacatatcccaagccagtaaaatattcataccctttgactcagtcatcccgtttcttggaatgtatcctcaggaaataatccaaaatatgagggaagccatatgtataaggttattctcctagacttgtcacttataataacagaaacttggaactagatgtctaacacttgatgactggattaatatgatgatggtaggttgagctggtagaatatcatgaagccagttatatatagcgacatgaaaaagctcttatttgatacaatgttaagtaaaggaaaagtgggataggaaattttatgttggttatgtttagaactagaaaaacatgcttttaggaaataggaaatatagctagatataaaagttgtatttggtgatttttcttttatttttcaagcttccaataatgtagctctattgcttcagtaacttaaaatagttttatcttttcggcaaaacatcgaaagtatggaaatagtcattcctactttggcaaacagaagagaaattttcttcagtaccaaaattctggaacttgactgaaaactatgaagaacctaagagccaggatgacaggaaggctctagatccccagtaattacaactctagtggaattgctctgagatgggccagcaagaaagaagatgagagccagtcccccttgcagaggggccaggtaccttgcagctttgtgtagtgaccagtgctcagggaacggcttaggcaagaccctgggggaggtgggcactgcacttgtccagcctcaggagtgactcagaccagaaatgaaaacaccttaaagtgtatatatcttgttttcctatcaacacctagtttttaatattcgtctgttttattcatctgagacaacataccaaaggattgggtttttaatgttaggccttcctgctctttctctggctgagaactgctcctggcagtggatcacttgtgctgtctaagtgtgcaaggacaggcgcccctcccaattcttttctttccccaagtaattagcccaagggctgaagccctcgttcagtgaccagggttctcctttgaccaccagcctcatattgccatggtttggggtaaattcaggggcataactgcagaatgaagggcctaggagtcttggcagtcaggagatcatcaggcaattaagcagagatgattgtgacccagggtggttcctagggattaatggaggcctggaagagtttatggctttgggtactgctgagagccattaacttaacacagaacatcaatccgtaggaaaagccagaggttttgttcccaggctttccaggttaggagatcacttaaatctttgtgaaagaaaaaaagtaatagtgtacatgacatttattcagcaccatatttataattatacatgagtgccaaacaatctcagttttaacatttgtggtttttactgttcagactattcagaagttccatgacgtggcatccattgatgatggttttgctgaggttgaaatgtgagggttttgtggcaggtgtgtggaagcagatcccttagctaagagagcgcctgctcaacctgccaggcgtgtgctgggaacttccaggagttgcctcgtttaattctcacagccatcctgggaggtaggcgctgtctgccccaggtgggaggccaggaactgtggctgagagaggttaagtaccgagctcaagtcattcatagagtcgccagtggagccgcaattttaaggctgactcaaagcctctgagccagttacctcggctgtcaaatggagataataatccctgctgacctcacggtcgctctgaaggacaaaagagaatcagttcaatccagtaaacaattctctctctccctcttactcccctcgcacacatgcacacacaccccacagatataatggattttagtttttaggcatcaaatgacttttgtgccttattaatattatccactgaatcaaaaacagcaagctgaaaaattcatctcaaggaagagaaaataagattgttgggaatggtgagaaaggaaacatggtttttgaaaattgattccagggaagataggctagtttgaatgccagtagggagccatcagaagaagtagttttacactgatttttaacaatattggagttgcttaaggcaatgcaatagagaggcagtttctgcccttttaaagcctgacttcactttctgaatgtgtgttctgatctagcagggttttttttttttttcttttaagatggtcccagcttgactgcattctcagatccatcagataaacgttagggcttcactgctgtgctgagaggccccagcccctggggttctctcatagaaacaactggaaagaaaggaaatgccttgggcagcagcagcagcagctgtcttctgattctgctttccgccctgccttccttaccaagagaaagtacagacacggacggcttgagtcacttaggcacttaggagttgtttttcacacgtgtggtgttttcgtcaccattactattgtgggaaagaagacaactcaggcatcgtttcgtattcactcatctgtgtgggtgacatgtgggttttggctcatttctgcatatttgtgtgcaaaggagagttttttagtaaacagtcccattacttagctgttcttgtaactctgaaaacccaactgaactataattaaactttgacttggtgactctgcaaacaggctatgattcttttgtttcttttctccttttaacccatagttgatgtatctaacctaacagaattttcagagaaaagaagtgaaataagaactaaaaataaatttttatgtctttaaaaatgagaggttttttttttttttttggcttttggaaggtgagtatcaaaaacctgtacttaatgttaccttggaattatttctagatgtttcttatatccttttgtcccaagtaaaattattaccttctcagtgcgtagtttttcttatttattacttctagtaccaagtgtagagctaagcgtagaggagacgcttcacaggtgcgcattgtcgtgattgcagacgcctgcctgtacttgtggggtttttctcagttttagtacgtgatgacttttctttctataacaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtagagcatatttataaagcagcttcctgaatcacaaatatatggtagttcattaactcaccaaaggcaacagcaggctgggctttcccatgaccagaggacctttcccaccctgatctgtttatagttgggatcaaaggtatcccgggagaatgggtcctttttattatggagcagacagattgtcctttgctaaggtcaggcagtcccagagctttctgagaggctgtttctgcacttaactcttttaggggacaggcccagagatgaacttggattcaggatgccgtggcctgttagctgaatgccagccgttgtcattactcaaagagaatctaagagcttttaacttctatgagcaaaaccagctaggtccacagagggatggtaaaggaggaaagtaacacagaaataaatataacaaaccagaagagatgataattctttgtgagtccttggtgcatatacaaagatttgattaatgaaggtctcagttctcccctctagaaacttccatttcaacacggatatactcaggtgaggacatacagaagaaagaccagttgagactgtgcacgcaggagggtgtgcagagcaagcactgaggtgcagcacggagaccagagctggccaggtccagcatcacccccacccccacatcacccaggcacactgcccaaaagaacacctaactgcggagtgcagctcttttgtcaatctgatggcatgaagcaaccatatgttctacttttttctactttttttaatgtcacaagtgtgtagcagtgctgtccctgttaaggagttgttttgagggtgtttttaaaagttgtttttgagtggctgtggataaaaatacatatttttgccgaaatttttatggtgttcctgggctgtcctgagaataagttccattctgatctaagcctctgatttttcttcatagaaagatgagctttgcagacacaagcttggcagcaaggtgagaaaggccagcctagtgagtcaagctatctgaaatgcattcctcccagcgggcattccatcccagcataccctatcagatatgtgaaagagaggaaccaagaccgaatgctattcctgcccagccctaataaccactcacattctgaaatttaacttctttttttcccctgagatgtcctaactgaaaatatgcctgtatacaatttaccctggaagtctcagccatcactcaagggaagtctccagagggtgaagagcctgtctggcctgtaggggtacacagtgtaggtggtcattttaaatggcttccaagccaatgataggtccctgaaatataacatggtggaaacttctaataaagctcacatttgcattgaagtgtttagcttgttaagataggcagttctcaaataaaaggtttgttttattgggtaaatgaccttgtagttttttggtgacagagcatagaaagtaatttcatgctgctcctgtgctattgtttttgtgaagacagggagctgtgaaaaactgcttagctacctacattcctcaataaaggcatcagacagtaattggtgattacagatgttctccctggaatggtcgttctcttgaccaagtagtcctacacttctggaaggatcattcagaactgtggtctatgccaacccaccagtagttcctgagtccctgcagtgctgagtgctgggggccaccaagttgagtaagacactgcagctctcaaagagttggatctaggattgtattgtatcgatttgtggtgtttggatatagtttttccatgatcccctacgaaaatatgcctctcatatgtaagaatcatgcctcctccgtgtacacttttcagacactgacaaggaagggtgttcaatacagtactgaattttcatatagcttttctgggggggccaaaataccaaaatcaacccatttcctacctttattctgtccataaaattgttagaaatatcaaaatcccatttcattccctgttaaatacatgtgaacgttgtctagacgctggagagcaaattctaccacctcttttgttcagcagtacatcagacgattgcatagacgtgccagatggaaccaaataataatgcacatggatttgtcataatccgtacaagtcattgacgcccacactgagccaggtgctgtgggagacaggaccatgtgtgaaagagaagacatgcttgcttctataaaagcatcggtgttattgaggagacctgacattaatgcagaatagcaaatgaccatgcaaattaattcactactaactaagctgcaggttgcacctcggaatgcagaggggcttcaaagtgatgagggtaggccctgagccaggccctgacgatgggtggattttgaggatcagagagtacagcttagagagataccccaagtgggaccaccccttgcccagtaggctgacaaactaaggctcttggtccctttttcatattttgggtgttctagtggcccagccagagctagacttcgagtcatgaattttctggcacaagtgttgtcacattcaaaaaagtattttctttgtttgaaaaatgaaaaatatatatatatgtgtgtgtgtatatatatgtgtgtgtgtgtgtatatatgtgtgtgtgtatatatacgtgtgtgtgtatatgtgtgtgtgtgtgtgtgtgtgtgtgtgtatatatgtgtatatatataccatttttcccacctaaaatggagcatggcaaatctggactggattagtgagatagaccaagtcacagagcactccaggatgcagctgtgagctggggaacaggtcagaaaggcctcagggacatcagcatacatgttggagtttctgcagttttcttagggaaccctttaatgtcactagagctaacacacttgtcacctgggaagcaagcctgccagagcaaattagagagacgagggacagttgctagaaagatacacctggaagttctatttaactagcattaattatgtgctaggtgctgaggatgtagactgagtgagatcctcattcctcctctgtagggtggaagagaggatattgcttgtctccatggctcgtagtgaacagtcagtgagaccaggcacataaacctcttagcagaacacttggcctttctaaggactccatatgtgttccggggtaaatgcctgtgtttcttgacgtagtgatgtcttgttcctctagacatcactaactttacacagtagctttagatggcgtggacgtgaataaatgcaacttaggttttcttgttggtttctttttgagtatcattgtgtttgtaaagaatttcagattagaggattgttaccacgtgggccttcaggaggaaactgttttgagtttttgtcagcccgaaatcgatttgtgcgtttaagtatatgtgctcatcaaaacaggccaggctctgctgcagtaacaaacttacaagtctccgaggcttggcacaacggaagtctttgtgtcactgacgcccacttcagctttgtgttgctgaagcattctttggccctatccaagctgtccctctggtggtggtgcctgggggtttgggttccctctgtgttgtgatccaccatctcagcatcggcttccacagcagccatagcaggagaagaaaatgctgggggctctcagggtgcttttaagggcctggccaccgacctgcaaggggtgcgagttgccttcctgtgtggccagaactgatgataaactgtagactcatccctgctgaaactcggctccagagtgctcccaaggctggacagcgtgtgggcactggatcccacctgtgttagcactggcaattgtattctcatttcttcttttattctccaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaa

SEQ ID NO: 29 - DNA, 3789 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 30 - protein, 1262 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 31 - DNA, 3627 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaacatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 32 - protein, 1208 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 33 - DNA, 510 bp, Homo sapiens
gtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaa

SEQ ID NO: 34 - protein, 139 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTK

SEQ ID NO: 35 - DNA, 465 bp, Homo sapiens
gtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacg

SEQ ID NO: 36 - protein, 155 aa, Homo sapiens
VPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFT

SEQ ID NO: 37 - DNA, 90 bp, Homo sapiens
attggccagtctgaagtttacctcatcagtcctgacaccaaaaaaatagcattggagaaaaattttaaggagatatccttttgctctcag

SEQ ID NO: 38 - protein, 30 aa, Homo sapiens
IGQSEVYLISPDTKKIALEKNFKEISFCSQ

SEQ ID NO: 39 - DNA, 105 bp, Homo sapiens
ggcatcagacacgtggaccactttgggtttatctgtcgggagtcttccggaggtggcggctttcattttgtctgttacgtgtttcagtgcacaaatgaggctctg

SEQ ID NO: 40 - protein, 35 aa, Homo sapiens
GIRHVDHFGFICRESSGGGGFHFVCYVFQCTNEAL

SEQ ID NO: 41 - DNA, 133 bp, Homo sapiens
gttgatgaaattatgatgaccctgaaacaggccttcacggtggccgcagtgcagcagacagctaaggcgccagcccagctgtgtgagggctgccccctgcaaagcctgcacaagctctgtgagaggatagagg

SEQ ID NO: 42 - protein, 44 aa, Homo sapiens
VDEIMMTLKQAFTVAAVQQTAKAPAQLCEGCPLQSLHKLCERIE

SEQ ID NO: 43 - DNA, 92 bp, Homo sapiens
gaatgaattcttccaaaacaaaactagaactgcaaaagcacctgacgacattaaccaatcaggagcaggcgactatttttgaagaggttcag

SEQ ID NO: 44 - protein, 30 aa, Homo sapiens
MNSSKTKLELQKHLTTLTNQEQATIFEEVQ

SEQ ID NO: 45 - DNA, 111 bp, Homo sapiens
aaattgagaccgagaaatgagcagcgagagaatgaattgattatttcttttctgagatgtttatatgaagagaaacagaaagaacacatccatattggggagatgaagcag

SEQ ID NO: 46 - protein, 37 aa, Homo sapiens
KLRPRNEQRENELIISFLRCLYEEKQKEHIHIGEMKQ

SEQ ID NO: 47 - DNA, 129 bp, Homo sapiens
acatcgcagatggcagcagagaatattggaagtgaattaccacccagtgccactcgatttaggctagatatgctgaaaaacaaagcaaagagatctttaacagagtctttagaaagtattttgtcccgg

SEQ ID NO: 48 - protein, 43 aa, Homo sapiens
TSQMAAENIGSELPPSATRFRLDMLKNKAKRSLTESLESILSR

SEQ ID NO: 49 - DNA, 87 bp, Homo sapiens
ggtaataaagccagaggcctgcaggaacactccatcagtgtggatctggatagctccctgtctagtacattaagtaacaccagcaaa

SEQ ID NO: 50 - protein, 29 aa, Homo sapiens
GNKARGLQEHSISVDLDSSLSSTLSNTSK

SEQ ID NO: 51 - DNA, 281 bp, Homo sapiens
gagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaa

SEQ ID NO: 52 - protein, 93 aa, Homo sapiens
EPSVCEKEALPISESSFKLLGSSEDLSSDSESHLPEEPAPLSPQQAFRRRANTLSHFPIECQEPPQPARGSPGVSQRKLMRYHSVSTETPHER

SEQ ID NO: 53 - DNA, 242 bp, Homo sapiens
gagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgag

SEQ ID NO: 54 - protein, 80 aa, Homo sapiens
EPSVCEKEALPISESSFKLLGSSEDLSSDSESHLPEEPAPLSPQQAFRRRANTLSHFPIECQEPPQPARGSPGVSQRKLM

SEQ ID NO: 55 - DNA, 162 bp, Homo sapiens
tgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagag

SEQ ID NO: 56 - protein, 53 aa, Homo sapiens
VDPSPVGESKHRPGQSSAPAPPPRLNPSASSPNFFKYLKHNSSGEQSGNAVPK

SEQ ID NO: 57 - DNA, 120 bp, Homo sapiens
catctcctaccgtaatgccctgcggaaaaaacttcattcttcttcctctgtgccaaattttctaaaatttctggctcctgtagatgaaaataacacctctgattttatgaacacaaaaag

SEQ ID NO: 58 - protein, 39 aa, Homo sapiens
ISYRNALRKKLHSSSSVPNFLKFLAPVDENNTSDFMNTK

SEQ ID NO: 59 - DNA, 140 bp, Homo sapiens
ggactttgaatccaaagcaaaccatcttggtgattctggtgggactcctgtgaagacccggaggcattcctggaggcagcagatattcctccgagtagccaccccgcagaaggcgtgcgattcttccagcagatatgaag

SEQ ID NO: 60 - protein, 46 aa, Homo sapiens
DFESKANHLGDSGGTPVKTRRHSWRQQIFLRVATPQKACDSSSRYE

SEQ ID NO: 61 - DNA, 39 bp, Homo sapiens
aacctcactgtggatcgccatcgttggcctgtactgaag

SEQ ID NO: 62 - protein, 12 aa, Homo sapiens
PHCGSPSLACTE

SEQ ID NO: 63 - DNA, 186 bp, Homo sapiens
attattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaag

SEQ ID NO: 64 - protein, 61 aa, Homo sapiens
YSELGELPPRSPLEPVCEDGPFGPPPEEKKRTSRELRELWQKAILQQILLLRMEKENQKLQ

SEQ ID NO: 65 - DNA, 162 bp, Homo sapiens
cctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaag

SEQ ID NO: 66 - protein, 53 aa, Homo sapiens
SENDLLNKRLKLDYEEITPCLKEVTTVWEKMLSTPGRSKIKFDMEKMHSAVGQ

SEQ ID NO: 67 - DNA, 159 bp, Homo sapiens
gtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttg

SEQ ID NO: 68 - protein, 52 aa, Homo sapiens
VPRHHRGEIWKFLAEQFHLKHQFPSKQQPKDVPYKELLKQLTSQQHAILIDL

SEQ ID NO: 69 - DNA, 245 bp, Homo sapiens
ggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacag

SEQ ID NO: 70 - protein, 81 aa, Homo sapiens
RTFPTHPYFSAQLGAGQLSLYNILKAYSLLDQEVGYCQGLSFVAGILLLHMSEEEAFKMLKFLMFDMGLRKQYRPDMIILQ

SEQ ID NO: 71 - DNA, 160 bp, Homo sapiens
atccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttg

SEQ ID NO: 72 - protein, 53 aa, Homo sapiens
IQMYQLSRLLHDYHRDLYNHLEEHEIGPSLYAAPWFLTMFASQFPLGFVARVF

SEQ ID NO: 73 - DNA, 170 bp, Homo sapiens
atatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcag

SEQ ID NO: 74 - protein, 56 aa, Homo sapiens
MIFLQGTEVIFKVALSLLGSHKPLILQHENLETIVDFIKSTLPNLGLVQMEKTINQ

SEQ ID NO: 75 - DNA, 174 bp, Homo sapiens
gtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcag

SEQ ID NO: 76 - protein, 58 aa, Homo sapiens
VFEMDIAKQLQAYEVEYHVLQEELIDSSPLSDNQRMDKLEKTNSSLRKQNLDLLEQLQ

SEQ ID NO: 77 - DNA, 485 bp, Homo sapiens
gtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 78 - protein, 66 aa, Homo sapiens
VANGRIQSLEATIEKLLSSESKLKQAMLTLELERSALLQTVEELRRRSAEPSDREPECTQPEPTGD

SEQ ID NO: 79 - DNA, 249 bp, Homo sapiens
gctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacag

SEQ ID NO: 80 - DNA, 127 bp, Homo sapiens
acttccctcctagagcaatggcacctgcaggtaagagctgagtggtgagctcttacttctgcactctgcactgggccagtatggatctccccaaccacatttgacagtcttcatcctgccataccag

SEQ ID NO: 81 - DNA, 3546 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 82 - protein, 1181 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 83 - DNA, 3828 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 84 - protein, 1275 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 85 - DNA, 3666 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaacatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 86 - protein, 1221 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNISYRNALRKKLHSSSSVPNFLKFLAPVDENNTSDFMNTKRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 87 - DNA, 3708 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 88 - protein, 1235 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 89 - DNA, 3669 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 90 - protein, 1222 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 91 - DNA, 3468 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 92 - protein, 1155 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 93 - DNA, 3750 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 94 - protein, 1249 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMSVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 95 - DNA, 3588 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 96 - protein, 1195 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 97 - DNA, 3507 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 98 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 99 - DNA, 3789 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 100 - protein, 1262 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMSVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 101 - DNA, 3627 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 102 - protein, 1208 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMSISYRNALRKKLHSSSSVPNFLKFLAPVDENNTSDFMNTKRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 103 - DNA, 3669 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 104 - protein, 1222 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMSVDPSPVGESKHRPGQSSAPAPPPRLNPSASSPNFFKYLKHNSSGEQSGNAVPKRDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 105 - DNA, 3630 bp, Homo sapiens
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgagtgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactga

SEQ ID NO: 106 - protein, 1209 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMSVDPSPVGESKHRPGQSSAPAPPPRLNPSASSPNFFKYLKHNSSGEQSGNAVPKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 107 - DNA, 21 bp, Homo sapiens
aguauuuugucccgggguatt

SEQ ID NO: 108 - DNA, 21 bp, Homo sapiens
uaccccgggacaaaauacutt

---

What is claimed is:

1. A method for determining that a human subject is at risk for developing obesity comprising:

assaying a sample from a human subject, said sample comprising a TBC1D1-encoding nucleic acid molecule or the complement thereof, detecting a cytidine to thymidine alteration at the 373$^{rd}$ nucleotide of the TBC1D1 coding sequence of SEQ ID NO:1, wherein the presence of said cytidine to thymidine alteration identifies the subject as being at risk for developing obesity.

2. The method of claim 1 wherein said assaying step is conducted on genomic DNA.

3. The method of claim 1 wherein said assaying step is conducted on mRNA.

4. The method of claim 1, wherein said cytidine to thymidine alteration is detected by a method selected from the group consisting of:

a) hybridizing a probe specific for said alteration to RNA isolated from said human sample and detecting the presence of a hybridization product, wherein the presence of said product indicates the presence of said alteration in the sample;

b) hybridizing a probe specific for said alteration to cDNA made from RNA isolated from said sample and detecting the presence of a hybridization product, wherein the presence of said product indicates the presence of said alteration in the sample;

c) hybridizing a probe specific for said alteration to genomic DNA isolated from said sample and detecting the presence of a hybridization product, wherein the presence of said product indicates the presence of said alteration in the sample;

d) amplifying all or part of said TBC1D1-encoding nucleic acid molecule, or complement thereof, in said sample using a set of primers to produce amplified nucleic acids and sequencing the amplified nucleic acids;

e) amplifying part of said TBC1D1-encoding nucleic acid molecule, or complement thereof, in said sample using a primer specific for said alteration and detecting the presence of an amplified product, wherein the presence of said product indicates the presence of said alteration in the sample;

f) molecularly cloning all or part of said TBC1D1-encoding nucleic acid molecule, or complement thereof, in said sample to produce a cloned nucleic acid and sequencing the cloned nucleic acid;

g) amplifying said TBC1D1-encoding nucleic acid molecule, or complement thereof, to produce amplified nucleic acids, hybridizing the amplified nucleic acids to a DNA probe specific said alteration and detecting the presence of a hybridization product, wherein the presence of said product indicates the presence of said alteration;

h) forming single-stranded DNA from a gene fragment of said TBC1D1-encoding nucleic acid molecule, or complement thereof, from said human sample and single-stranded DNA from a corresponding fragment of a wild-type gene, electrophoresing said single-stranded DNAs on a non-denaturing polyacrylamide gel and comparing the mobility of said single-stranded DNAs on said gel to determine if said single-stranded DNA from said sample is shifted relative to wild-type and sequencing said single-stranded DNA having a shift in mobility;

i) forming a heteroduplex consisting of a first strand of nucleic acid selected from the group consisting of a genomic DNA fragment isolated from said sample, an RNA fragment isolated from said sample and a cDNA fragment made from mRNA from said sample and a second strand of a nucleic acid consisting of a corresponding human wild-type gene fragment, analyzing for the presence of a mismatch in said heteroduplex, and sequencing said first strand of nucleic acid having a mismatch;

j) forming single-stranded DNA from said TBC1D1-encoding nucleic acid molecule, or complement thereof, of said human sample and from a corresponding fragment of an allele specific for said alteration, electrophoresing said single-stranded DNAs on a non-denaturing polyacrylamide gel and comparing the mobility of said single-stranded DNAs on said gel to determine if said single-stranded DNA from said sample is shifted relative to said allele, wherein no shift in electrophoretic mobility of the single-stranded DNA relative to the allele indicates the presence of said alteration in said sample; and k) forming a heteroduplex consisting of a first strand of nucleic acid selected from the group consisting of a genomic DNA fragment of said TBC1D1-encoding nucleic acid molecule, or complement thereof, isolated from said sample, an RNA fragment isolated from said sample and a cDNA fragment made from mRNA from said sample and a second strand of a nucleic acid consisting of a corresponding gene allele fragment specific for said alteration and analyzing for the presence of a mismatch in said heteroduplex, wherein no mismatch indicates the presence of said alteration.

5. The method of claim 1, wherein said assaying step comprises hybridizing a nucleic acid probe specifically hybridizable to an altered TBC1D1 coding sequence or complement thereof.

6. A method for predicting, in a human subject, the likelihood of developing obesity associated with a genetic variant of the human TBC1D1 gene comprising:

detecting the presence of a cytidine to thymidine alteration at the $373^{rd}$ nucleotide of the TBC1D1 coding sequence of SEQ ID NO:1, wherein the presence of said cytidine to thymidine alteration predicts that said subject has an increased likelihood of developing obesity.

7. The method of claim 6, wherein said cytidine to thymidine alteration is detected by determining the genomic sequence of said TBC1D1 gene.

* * * * *

UNITED STATES PATENT AND TRADEMARK OFFICE
CERTIFICATE OF CORRECTION

| | | |
|---|---|---|
| PATENT NO. | : 7,314,713 B1 | Page 1 of 1 |
| APPLICATION NO. | : 10/655543 | |
| DATED | : January 1, 2008 | |
| INVENTOR(S) | : Donna M. Shattuck et al. | |

It is certified that error appears in the above-identified patent and that said Letters Patent is hereby corrected as shown below:

In the Specification

Column 1; line 12, Add:

--GOVERNMENT INTEREST

This invention was made with government support under grant number R01 DK044655 awarded by National Institutes of Health. The Government has certain rights to this invention.--

Signed and Sealed this
Seventh Day of July, 2015

Michelle K. Lee
*Director of the United States Patent and Trademark Office*